United States Patent 7,745,391 (HUMAN THROMBOSPONDIN POLYPEPTIDE) - sequence listing, part 282

SEQ ID NO: 872080 - protein, 510 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872081 - protein, 499 aa, Homo sapiens
GCERNPWTVGVRGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872082 - protein, 457 aa, Homo sapiens
SQDRGWGLLGSWGSRAPQASACPFVSSRLVGNLVCEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872083 - protein, 488 aa, Homo sapiens
SQDRGWGLLGSWGSRAPQASACPFVSSRLVGNRSGEEGRLPQWRGWGQASLSPNEKTFFLPLPHFSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872084 - protein, 517 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKFPHPYPQIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872085 - protein, 603 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRVRCPFSCQPPFALEALDRGSASDVLRPWWSLLCCSETLSPSLCCQLQPLPNTLCLPHVELGACYPVPTPLLSLDLPLLITLLPSPMAWGFAKQCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872086 - protein, 312 aa, Homo sapiens [sequence omitted]

SEQ ID NO: 872087 - protein, 510 aa, Homo sapiens; identical to SEQ ID NO: 872080

SEQ ID NO: 872088 - protein, 205 aa, Homo sapiens [sequence omitted]

SEQ ID NO: 872089 - protein, 251 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYEWMRVLWALVIPSSSPTRTFESETMCGMMQSSSVLLLNCPGRSSAECRWGSRGKDDGA

SEQ ID NO: 872090 - protein, 510 aa, Homo sapiens; identical to SEQ ID NO: 872080

SEQ ID NO: 872091 - protein, 510 aa, Homo sapiens; identical to SEQ ID NO: 872080

SEQ ID NO: 872092 - protein, 510 aa, Homo sapiens; identical to SEQ ID NO: 872080

SEQ ID NO: 872093 - protein, 352 aa, Homo sapiens
MKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872094 - protein, 533 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQVGSDVRAGTTSPLAGTELQPSHQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872095 - protein, 510 aa, Homo sapiens; identical to SEQ ID NO: 872080

SEQ ID NO: 872096 - protein, 463 aa, Homo sapiens
VLVLLRSRRRPEPGAPLQRGAGCGAAACLAPLARAGRSPAMPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQWVHVIIHVSPMKHEQRRLTYQ

SEQ ID NO: 872097 - protein, 96 aa, Homo sapiens
SCRYFRWPCSFNVFSLLDQSDPGLAKPQHVTETFHPDPNWKNFQKPGTWRGSLDESSLGFGYPKFISHQDIRKRNYVRDDAVFIRAAVELPRKILS

SEQ ID NO: 872098 - protein, 1075 aa, Homo sapiens
MCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDIVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 872099 - protein, 171 aa, Homo sapiens
MYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKFEDDLVSTGLLRVLRKLKKLYGGFNDHGVEREFWRGRQKQVGF

SEQ ID NO: 872100 - protein, 918 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAESVDQTQQLVPLVRNTARDHDGTPENEGEETVQSALFGFQYDASDHTMAWLGPNTVPEVKEMILQDPQLQTTQLPQTTQAPDITWGMLKKTTYKAEQILLQTQKPFTPDNLFLALLSGDAKPEYEQ

SEQ ID NO: 872101 - protein, 1195 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPEIKKKKVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 872102 - protein, 817 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTARHGGSRL

SEQ ID NO: 872103 - protein, 918 aa, Homo sapiens; identical to SEQ ID NO: 872100

SEQ ID NO: 872104 - protein, 404 aa, Homo sapiens
MYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAESVDQTQQLVPLVRNTARDHDGTPENEGEETVQSALFGFQYDASDHTMAWLGPNTVPEVKEMILQDPQLQTTQLPQTTQAPDITWGMLKKTTYKAEQILLQTQKPFTPDNLFLALLSGDAKPEYEQ

SEQ ID NO: 872105 - protein, 615 aa, Homo sapiens
MVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPEIRKRKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDIVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 872106 - protein, 1978 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDIVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 872107 - protein, 820 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAGWSSVVESQFIAVSTSQVQVLLPPHPPE

SEQ ID NO: 872108 - protein, 814 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAGLLPTGGGNNYPQIVLAPGLCH

SEQ ID NO: 872109 - protein, 470 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQHSLQPPPPGFK

SEQ ID NO: 872110 - protein, 44 aa, Homo sapiens
MRQQLSAQQKQYIKVLKQLLKASRASVSQAQLRVLRQTVVSHNP

SEQ ID NO: 872111 - protein, 376 aa, Homo sapiens
RAGQIKLGAALRAGPQRMRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRFLCDQWGRTADPWGDRGAHQAPAGHCNQPRAAENMANQGRREAGRDIFLCLFGEFGEVIELFKTLETNRTQYNLH

SEQ ID NO: 872112 - protein, 351 aa, Homo sapiens
RAGQIKLGAALRAGPQRMRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRFLCDQWGRTADPWGDRGAHQAPAGHCNQPRAAENMANQGRREAGRDTTCP

SEQ ID NO: 872113 - protein, 507 aa, Homo sapiens
RAGQIKLGAALRAGPQRMRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 872114 - protein, 507 aa, Homo sapiens; identical to SEQ ID NO: 872113

SEQ ID NO: 872115 - protein, 507 aa, Homo sapiens; identical to SEQ ID NO: 872113

SEQ ID NO: 872116 - protein, 151 aa, Homo sapiens
MICEASFPPLSCRCFILFSSFGPKEADEESWSERDPGSHSNFPLTCCETLASSLACLSLSFPPCKMDIKISAPLSCSSINVILYTACLVPAPVQMLRKYRPYLGALLSMKTGPLAKEKYFVISACSCPCPHEQVSSLSPPALLRTRFLIQI

SEQ ID NO: 872117 - protein, 221 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGGTNRRFLQG

SEQ ID NO: 872118 - protein, 342 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQPRFPPVLLRPGEEYDHTTWFKFSVA

SEQ ID NO: 872119 - protein, 270 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSNTPPSPGSSFTRATSWMAH

SEQ ID NO: 872120 - protein, 383 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNRPTLGKKDRQALETGAIRVRREPCLSQHSEDDIAPGTEIVCDKAGAPSFLDNQSISDGFWLVILKKKKKSMLY

SEQ ID NO: 872121 - protein, 283 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVPPGSSFLWLKEV

SEQ ID NO: 872122 - protein, 342 aa, Homo sapiens; identical to SEQ ID NO: 872118

SEQ ID NO: 872123 - protein, 283 aa, Homo sapiens; identical to SEQ ID NO: 872121

SEQ ID NO: 872124 - protein, 221 aa, Homo sapiens; identical to SEQ ID NO: 872117

SEQ ID NO: 872125 - protein, 270 aa, Homo sapiens; identical to SEQ ID NO: 872119

SEQ ID NO: 872126 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 872127 - protein, 1327 aa, Homo sapiens
MEFLSEVNKWLRQNSVIAFIALNRPSLTHKITLTVYYNFRSNYSSEPIVSFTLFPSKELVTLSENDSSSHDLKHCEEKSFKWHAKPYEGRAAIKPTFFEQTETKLLSFQNCVIFLNPIFNNFSFCQFFTLSLICEQHLLFTLEYTFLVIKLLEIILFLKALCFFALLIISSKTTSACFFQIKHFLSNNGLFSKQKLFSINLQTDDFTFFYFFSIIRVLSKCYIVYSKIVPGIKRLRGKHKSPNFWFMFLSPEQYFLTHIPLSYHLAKDSLNFPIFCPKYCDLLVYKPSHLPCAVILQVRCYYTYHLFSWIAEHSSGFIELRISVSAQDFHVCVLLALFFIQPLESIFSLLARNFFHSYYSSINKLFLSCLVHFHLVLLPLNIFHMHFRIFFSNICRTTLNQNEIMFLLQFEALRINDQFEVYTDLFLPEELSYVLLYLYLGQLIVGCPTFFNIGKIMIKCFEKLICQIKITNSLLFHSSMFKTNNFLSPVFLSKLLKKYERWKVYIIFINFKLYIRLLKSVIYKQAKFILNDLMYANTHLINKCFLKLTFNCYHKVLYVEKWGPFEYKIIQLKILKFISLDGNVTLKDIIIGKVLILVPLTKSYLYTRIRSLKELDLNYSLDKNDLIVNFLKLSKCIIGKEKKPTVTSVGSYKKAHTEMLKYTYAISLKPQSNHMSIVINIPILQMRKLKLREAKKYAQGPHLVTDKAGISVYVCLSPHLFHPYHTAYMPYDRMCNGLTFFKKFRPGAVAYAYNPRTLGGRAGWIMRSDVQHQPGQDGETPSLLKIFFKNLLSVVVGACSPSYSGGYRQENLLNPRGGGCSELRRATALQPRRQSKTASKKKHKNSVTILWHNFHLYMSQTTYLNDFGKLGKYEICRHIYADCCLRNNYYILDKTQSCIFHHESSKSFHFTPNISYIAELMDKVNFTEKVKIALGTETFPKIDSIADLGELTKNFSLINPLNPSSKLLLLITLENLLIYRTNGVGYEEGYKDIMSFLLKFSIASLHVSTCSRKCALVLNVKIFKERKEHSSKCGLQWELSQNIGKYFYLNYFQIDFYSQVELVGCSCYTEISSLCTVPPESHLKWKNISMSFSFFHIYGHEYFIGDALTPRILRLYFHTTFYKVMLNLLPVMCRLLCNYSQIASYIAFIFPSNFFKVKIRTHMLIIYDQSFWKFVTLPHKPQETFSECNVSKCTVTGSLLSSIIRLHFNFVDYELCKLYPKLSCMIPSYNIFLDSSKSGKSLFELVTLKFVIKKEGFSTSFQINIKKRGNHRAFKCTFPLLSLNHLIVRLGAVAHACNPSTLGGRDGGSRGQGTEIILANTMKPHLY

SEQ ID NO: 872128 - protein, 108 aa, Homo sapiens
PAQLPVALVGPQLPEAKFPRPRSGLTVASPGSAPALRWHLQAPNGLRSVGSSRPSLGLPAASAGPNRPEVGLSRPSLGLPAASAGPSHPQIGLELGLEEQQVGLPGPN

SEQ ID NO: 872129 - protein, 639 aa, Homo sapiens
AKAALRVAAMSVSSGVQILTKPETVDRRRSAETTKEAGRPLEMAVSEPEASAAEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 872130 - protein, 103 aa, Homo sapiens
QAHPWSSRGHVAWPSCGHPAGMWHVHPVVIPQARGVAIPWSSRRHVACSSVVILQAHGLAVLWLQLSLAWLQHPVLVFGVLLMASDVEHLFMCFIRLIISLLW

SEQ ID NO: 872131 - protein, 308 aa, Homo sapiens [sequence omitted]

SEQ ID NO: 872132 - protein, 179 aa, Homo sapiens
MRALVLLLSLFLLGGQAQHVSDWTYSEGALDEAHWPQHYPACGGQRQSPINLQRTKVRYNPSLKGLNMTGYETQAGEFPMVNNGHTDWQAELFLPSLSSPCGEGAKHKGQRQWLCSPSLDSWWEAIIDGGSLWATLAECGLRAEGPEEGRHMEEKSPASQGACSGSRLPISRGPCTFFL

SEQ ID NO: 872133 - protein, 216 aa, Homo sapiens
AASRWAEARGVRRGPGGSQESQAEAEPPPLPPGAFPAVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 872134 - protein, 287 aa, Homo sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 872135 - protein, 101 aa, Homo sapiens
RAMVLERGKQIIGSCDITEWTPLTAAAASASHPAPCLSRAPAQPWGCVLSTHLACTLDKGPQDQAEGASVLATQESSRSTGKRNSLSPSLAPSSRDPSASR

SEQ ID NO: 872136 - protein, 127 aa, Homo sapiens
NSGCVTDLRADGPGPWGAARGTASPAAPRSKTAVKSAAVSRAAVAAAAPAVAVGALAAGALAAGAAAADRLAVDLAAEAVEAAEAAGVAAVDPVAVGPVAAAPGAVGLCAASPHLYATQNEDLSLHH

SEQ ID NO: 872137 - protein, 306 aa, Homo sapiens
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQASITQSRPAPFTSAPPAPTSCCFLFQIQ

SEQ ID NO: 872138 - protein, 510 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872139 - protein, 510 aa, Homo sapiens; identical to SEQ ID NO: 872138

SEQ ID NO: 872140 - protein, 510 aa, Homo sapiens; identical to SEQ ID NO: 872138

SEQ ID NO: 872141 - protein, 510 aa, Homo sapiens; identical to SEQ ID NO: 872138

SEQ ID NO: 872142 - protein, 517 aa, Homo sapiens
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872143 - protein, 513 aa, Homo sapiens
FFLLLLVLESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872144 - protein, 372 aa, Homo sapiens
MESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872145 - protein, 190 aa, Homo sapiens
MKKTGFEVPSETGPANLAPPTSPRVCYISVSLRTSLTETDHSKQRLGGGKTRKEEENKSCYLWKIQRYGIVLDAGSSHTSLYIYKWPAEKENDTGVVHQVEECRVKGPGISKFVQKVNEIGIYLTDCMERAREVIPRSQHQETPVYLGATAGMRLLRVPGSLLAKRKVPMAGLLSTICWANSVRKQGGSA

SEQ ID NO: 872146 - protein, 510 aa, Homo sapiens; identical to SEQ ID NO: 872138

SEQ ID NO: 872147 - protein, 72 aa, Homo sapiens
AVGVRRTERFRAHFAAQRTEPGLRCKETPEAGTRIANFFSPRIPTAFCYKQQRMNEDRKLEPRSGILLMTNT

SEQ ID NO: 872148 - protein, 517 aa, Homo sapiens; identical to SEQ ID NO: 872142

SEQ ID NO: 872149 - protein, 72 aa, Homo sapiens; identical to SEQ ID NO: 872147

SEQ ID NO: 872150 - protein, 510 aa, Homo sapiens; identical to SEQ ID NO: 872138

SEQ ID NO: 872151 - protein, 510 aa, Homo sapiens; identical to SEQ ID NO: 872138

SEQ ID NO: 872152 - protein, 469 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872153 - protein, 507 aa, Homo sapiens
MQESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872154 - protein, 402 aa, Homo sapiens
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 872155 - protein, 144 aa, Homo sapiens [sequence omitted]

SEQ ID NO: 872156 - protein, 276 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQMPSAF

SEQ ID NO: 872157 - protein, 164 aa, Homo sapiens
FGCWSQGYRPTVPASAGLRGGEQSRREAQAVWTSLLPNLCWPLILCHPWLRGVSPERDLRGKSGLGSEKSVTLRSAPHLCLNRAGLSLTPPLAAQLGFPPEHHASSSTGAACFPRLLWNWPEVPDAVHCAAALRALQPERQFTGFWENSAASPARGQGHSFAGG

SEQ ID NO: 872158 - protein, 113 aa, Homo sapiens
QGQLSQVRVGMTHGLLELGWWSWKGRPMPLGEGLCAEGCPQRPGYQEHCSRQGAFLPDLAGRKTWSAFPPCRAAPHGPGFLESLTALCGRLVLILRTPLLAVNFRARDMRPLF

SEQ ID NO: 872159 - protein, 169 aa, Homo sapiens
FGCWSQGYRPTVPASAGLRGGEQSRREAQAVWTSLLPNLCWPLILCHPWLRGVSPERDLRGKSGLGSEKSVTLRSAPHLCLNRAGLSLTPPLAAQLGFPPEHHASSSTGAACFPRLLWNWPEVPDAVHCAAALRALQPERQFTGFWENSAASPARGQGLHPMDLGSWSL

SEQ ID NO: 872160 - protein, 164 aa, Homo sapiens; identical to SEQ ID NO: 872157

SEQ ID NO: 872161 - protein, 80 aa, Homo sapiens
LGPNTDSPEPGPPSVGPPSLPHPDPGALQPQHGHLRLNQSDPGVFTLTREFPGPNSAPDPAPPSSHSRPLGSTIKSAWFQ

SEQ ID NO: 872162 - protein, 126 aa, Homo sapiens
RTRGSTHASTLTDSPIGVTGTLRLLPGLSLTMLSRVVLSAAATAAPSLKNAAFLGPGVLQATRTFHTGQPHLVPVPPLPEYGGKVRYGLIPEEFFQFLYPKTGVTGPYVLGTGLICVRFIQRNICD

SEQ ID NO: 872163 - protein, 83 aa, Homo sapiens
ALGRGKGAPRPGISAHRTGTAQPPTAVPCRRAHLGEDSTPGPPGALGGVGFPSASPRFQLQPRLKLDAGRRLRSGSKPHVVHL

SEQ ID NO: 872164 - protein, 83 aa, Homo sapiens; identical to SEQ ID NO: 872163

SEQ ID NO: 872165 - protein, 83 aa, Homo sapiens; identical to SEQ ID NO: 872163

SEQ ID NO: 872166 - protein, 83 aa, Homo sapiens; identical to SEQ ID NO: 872163

SEQ ID NO: 872167 - protein, 83 aa, Homo sapiens; identical to SEQ ID NO: 872163

SEQ ID NO: 872168 - protein, 105 aa, Homo sapiens
MRIYLSLCQAHLLGPPRRLGYDIADRLSKDARGYIGDAQTTGTFHTGQPHLVPVPPLPEYGGKVRYGLIPEEFFQFLYPKTGVTGPYVLGTGLICVRFIQRNICD

SEQ ID NO: 872169 - protein, 83 aa, Homo sapiens; identical to SEQ ID NO: 872163

SEQ ID NO: 872170 - protein, 90 aa, Homo sapiens
MQARTKRGRGNRTSQLAIRSGPEIDSGTRQQGVASPSESRTGAEEPTAEDGAGQDRDTTIGTRARHSGVETKQAADRQQPTTQTKTRPDP

SEQ ID NO: 872171 - protein, 110 aa, Homo sapiens
MLSRVVLSAAATAAPSLKNAAFLGPGVLQATRTFHTGQPHLVPVPPLPEYGGKVRYGLIPEEFFSVLGKRNWKNSSGSVQFLYPKTGVTGPYVLGTGLICVRFIQRNICD

SEQ ID NO: 872172 - protein, 83 aa, Homo sapiens; identical to SEQ ID NO: 872163

SEQ ID NO: 872173 - protein, 83 aa, Homo sapiens; identical to SEQ ID NO: 872163

SEQ ID NO: 872174 - protein, 116 aa, Homo sapiens
GRVGRPTRRRTLRLLPGLSLTMLSRVVLSAAATAAPSLKNAAFLGPGVLQATRTFHTGQPHLVPVPPLPEYGGKVRYGLIPEEFFQFLYPKTGVTGPYVLGTGLICVRFIQRNICD

SEQ ID NO: 872175 - protein, 240 aa, Homo sapiens
TAQNSVPAGSGSELRNAGQGWGQLGDATQDSNWTPAGDSAPAANPTWCTSEPPPLSRGNRNSTSRENCFYGSILLSGCRPHAIGSQRYLTLLAIIFFKNLPRKVEGRVQNFHLARLVSGHLGSALTDSPIGVTGTLRLLPGLSLTMLSRVVLSAAATAAPSLKNAAFLGPGVLQATRTFHTGQPHLVPVPPLPEYGGKVRYGLIPEEFFQFLYPKTGVTGPYVLGTGLICVRFIQRNICD

SEQ ID NO: 872176 - protein, 83 aa, Homo sapiens; identical to SEQ ID NO: 872163

SEQ ID NO: 872177 - protein, 83 aa, Homo sapiens; identical to SEQ ID NO: 872163

SEQ ID NO: 872178 - protein, 83 aa, Homo sapiens; identical to SEQ ID NO: 872163

SEQ ID NO: 872179 - protein, 87 aa, Homo sapiens
AVSDASIVVLPDLKMANRRDDNYSCSELDNLAVGLIISEDPCFCTECRNLTHRVQGYCRQQGPFIQGSHTLSLYHLFLNTEEKFVMD

SEQ ID NO: 872180 - protein, 83 aa, Homo sapiens; identical to SEQ ID NO: 872163

SEQ ID NO: 872181 - protein, 83 aa, Homo sapiens; identical to SEQ ID NO: 872163

SEQ ID NO: 872182 - protein, 171 aa, Homo sapiens
HNVPVITGSKDLQNVNIIPCILFGPVTSQLPRIFTRIGEDYDERVLPSITTEILKSVVARFDAGELITQRELVSRQVSDDLMERAATFGLILDDVSLTHLTFRKEFTEAAGSQTGGSAGCREGQNSLATAGDGLMELCKLEAAEDITYQLSRSWNITNLPAGQSVLLQLPQ

SEQ ID NO: 872183 - protein, 162 aa, Homo sapiens
DPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWD

SEQ ID NO: 872184 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 872185 - protein, 108 aa, Homo sapiens
MNPPEVCLLASCVTINLSALAGCADSLRRVPLTLGASGVISHTGVTYTHTHIHAHTCVHIHAGLQLGGGLCLAGRRDTQATLLVLVLAQLLTRGLVRVSGSDERWVSA

SEQ ID NO: 872186 - protein, 241 aa, Homo sapiens; identical to SEQ ID NO: 872184

SEQ ID NO: 872187 - protein, 256 aa, Homo sapiens
PQLSYGYDEKSTGGISVPGPMGPSGPRGLPGPPGAPGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 872188 - protein, 55 aa, Homo sapiens
MIAECKTRTEVFEISRRLIDRTNANFLVWPPCVEVQRCSGCCNNRNVQCRPTQVQ

SEQ ID NO: 872189 - protein, 95 aa, Homo sapiens
MNRCWALFLSLCCYLRLVSAEGDPIPEELYEMLSDHSIRSFDDLQRLLHGDPGEEDRAEMYLNMIPHQPLDSSCRARLDYREVTWVATDQQMTRR

SEQ ID NO: 872190 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 872191 - protein, 266 aa, Homo sapiens
KGETGEQGDRGIKGHRGFSGLQGPPGPPGSPGEQGPSGASGPAGPRGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 872192 - protein, 262 aa, Homo sapiens
GPKGDRGDAGPKGADGSPGKDGVRGLTGPIGPPGPAGAPGDKGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 872193 - protein, 244 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872194 - protein, 298 aa, Homo sapiens
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872195 - protein, 111 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKGSYMTQTSSTAAAALIGQS

SEQ ID NO: 872196 - protein, 244 aa, Homo sapiens; identical to SEQ ID NO: 872193

SEQ ID NO: 872197 - protein, 244 aa, Homo sapiens; identical to SEQ ID NO: 872193

SEQ ID NO: 872198 - protein, 389 aa, Homo sapiens
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTGGSNIPPDLRGLRYVIIVIPFLDREAPAIHTGVLEPKYQTQGLTIFHLIWNIRWFCPSAFSGHQVLPSWGKVGYWTPLGPKMTFPAPISERNDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872199 - protein, 333 aa, Homo sapiens
PPASSPQGARPLARFRSGGYKMTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKSMARESTGGDGAKRGCEEASASYPPMARPWCGDCHGIVGVWGKGNKVSLIFLVENTSVPVLFFLHPTLAIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872200 - protein, 159 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKV

SEQ ID NO: 872201 - protein, 113 aa, Homo sapiens [sequence omitted]

SEQ ID NO: 872202 - protein, 244 aa, Homo sapiens; identical to SEQ ID NO: 872193

SEQ ID NO: 872203 - protein, 244 aa, Homo sapiens; identical to SEQ ID NO: 872193

SEQ ID NO: 872204 - protein, 214 aa, Homo sapiens
MTEPGASPEDPWVKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872205 - protein, 244 aa, Homo sapiens; identical to SEQ ID NO: 872193

SEQ ID NO: 872206 - protein, 268 aa, Homo sapiens
MTEPGASPEDPWVKASPVGAHAGEGRAGRARARRGAGRRGASLLSPKSPTLSVPRGCREDSSHPACAKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872207 - protein, 249 aa, Homo sapiens
FPCSVPQVEYAYSDNSLDPGLFVESTRKGSVVSRANSIGSTSASSVPNTDDEDSDYHQEAYKESYKDRRRRAHTQAEQKRRDAIKGYKNPFPLLFPQRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872208 - protein, 256 aa, Homo sapiens
MMRTVITTRRPTRSPTKTGGGAHTLRLSRRGGTPSREAMMTFRPSSPLASSRTSPLAPKSSAKPSFYKRVWLGKALEGMEPSGGCEEASASYPPMARPWCGDCHGIVGVWGKGNKVSLIFLVENTSVPVLFFLHPTLAIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 872209 - protein, 82 aa, Homo sapiens
PLKIKWGWEKPNTKKKPTDQVKFNVFQGIMDSLFQSFNASISVASFQELSACVFSWIEEHCKPQTLREIVIGVLHQLKNQLY

SEQ ID NO: 872210 - protein, 159 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDSCPLSPLFKPQISAHDLHRFGNCFPLFWSLGQHFWPKFGQHLAQVWAFWQ

SEQ ID NO: 872211 - protein, 127 aa, Homo sapiens
AAAASTGRRRGRRRVRACGRIHHNMANLFIRKMVNPLLYLSRHTVKPRALSTFLFGSIRGAAPVAVEPGAAVRSLLSPGLLPHLLPALGFKNKTVLKKRCKDCYLVKRRGRWYVYCKTHPRHKQRQM

SEQ ID NO: 872212 - protein, 169 aa, Homo sapiens
MRPKFKLPPSQVSGSSTSQGFAHSPTLAAGGKGKEATVHCPLFSWHTWLIKAVFKLRSRLQLIHHNMANLFIRKMVNPLLYLSRHTVKPRALSTFLFGSIRGAAPVAVEPGAAVRSLLSPGLLPHLLPALGFKNKTVLKKRCKDCYLVKRRGRWYVYCKTHPRHKQRQM

SEQ ID NO: 872213 - protein, 127 aa, Homo sapiens; identical to SEQ ID NO: 872211

SEQ ID NO: 872214 - protein, 115 aa, Homo sapiens
AAAASTGRRRGRRRVRACGRIHHNMANLFIRKMVNPLLYLSRHTVKPRALSTFLFGSIRGAAPVAVEPGAAVRSLLSPGLLPHLLPALGFKNKTVLKKRCKDCYLVKRRGRWYVY

SEQ ID NO: 872215 - protein, 127 aa, Homo sapiens; identical to SEQ ID NO: 872211

SEQ ID NO: 872216 - protein, 103 aa, Homo sapiens [sequence omitted]

SEQ ID NO: 872217 - protein, 162 aa, Homo sapiens
MALICCFFPSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVSIPCPPHPTPRTPHHCCFGLS

SEQ ID NO: 872218 - protein, 337 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVSIPCPPHPTPRTPHHCCFGLS

SEQ ID NO: 872219 - protein, 619 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872220 - protein, 532 aa, Homo sapiens
MLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872221 - protein, 466 aa, Homo sapiens
MALICCFFPSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872222 - protein, 603 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKQLTFNPAPRSAGSPHPHSPHSIPHCSWLFPTPRWDSEGEQFNQKIAAALRVSAPSSGIPLRKDPQDTLSAPCGPLE

SEQ ID NO: 872223 - protein, 641 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872224 - protein, 566 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLLGPPTPTALTAFPIAPGSSPPLGGTVKGSSLTRRLLLPLGSQLPPQESLLGRTLRTPSLHPVVL

SEQ ID NO: 872225 - protein, 607 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSRIPLRKDPQDTLSAPCGPLE

SEQ ID NO: 872226 - protein, 128 aa, Homo sapiens
MDLSSGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872227 - protein, 641 aa, Homo sapiens; identical to SEQ ID NO: 872223

SEQ ID NO: 872228 - protein, 597 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872229 - protein, 365 aa, Homo sapiens
MLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872230 - protein, 454 aa, Homo sapiens
MSGLVLGQRDEPAGHRLSQEEILGSTRLVSQGLEALRSEHQAVLQSLSQTIECLQQGAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 872231 - protein, 641 aa, Homo sapiens; identical to SEQ ID NO: 872223

SEQ ID NO: 872232 - protein, 641 aa, Homo sapiens; identical to SEQ ID NO: 872223

SEQ ID NO: 872233 - protein, 482 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSR

SEQ ID NO: 872234 - protein, 286 aa, Homo sapiens
HEPARAAATPADCRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYR

SEQ ID NO: 872235 - protein, 155 aa, Homo sapiens
GRHRTCWATERRLWVDALDYWINHFNFPMNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQSI

SEQ ID NO: 872236 - protein, 322 aa, Homo sapiens
GRHRTCWATERRLWVDALDYWINHFNFPMNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 872237 - protein, 158 aa, Homo sapiens
MLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 872238 - protein, 189 aa, Homo sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 872239 - protein, 107 aa, Homo sapiens
MGQRVRMARPLEQAVAAIVCTFQEYAGRCGDKYKLCQAELKELLQKELATWTPTEFRECDYNKFMSVLDTNKDCEVDFVEYVRSLACLCLYCHEYFKDCPSEPPCSQ

SEQ ID NO: 872240 - protein, 175 aa, Homo sapiens
MNKASHVQFLQDGSSKVVPLDLKSCEEHSRCSQCLALLPRLECSGTISAHCNLRLLGSSDSPASASRVAGITVRMARPLEQAVAAIVCTFQEYAGRCGDKYKLCQAELKELLQKELATWTPTEFRECDYNKFMSVLDTNKDCEVDFVEYVRSLACLCLYCHEYFKDCPSEPPCSQ

SEQ ID NO: 872241 - protein, 44 aa, Homo sapiens
MSDKPGMAEIEKFDKSKLKKTETQEKNPLSSKETIEQERQAGES

SEQ ID NO: 872242 - protein, 290 aa, Homo sapiens
MALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 872243 - protein, 446 aa, Homo sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 872244 - protein, 387 aa, Homo sapiens
PPPPPQRYGRGCAGYSPAGAERATRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872245 - protein, 262 aa, Homo sapiens
TRGSTHASSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGGGSHQAGDKRLTDCLLSPQR

SEQ ID NO: 872246 - protein, 227 aa, Homo sapiens
MEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872247 - protein, 384 aa, Homo sapiens
GLFTSRSGAESGSGPGRRSAQRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872248 - protein, 227 aa, Homo sapiens; identical to SEQ ID NO: 872246

SEQ ID NO: 872249 - protein, 191 aa, Homo sapiens
MVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872250 - protein, 379 aa, Homo sapiens
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGAEAQGGAGPSLELPGSLRPWLPPGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872251 - protein, 322 aa, Homo sapiens
GLFTSRSGAESGSGPGRRSAQRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPRSCGRLRGREPGWSPRCCSHRASVFPNLLCMLSAAAPPS

SEQ ID NO: 872252 - protein, 166 aa, Homo sapiens [sequence omitted]

SEQ ID NO: 872253 - protein, 42 aa, Homo sapiens
DKTSFSSRFGQGSIIGVHLDTWHGTLTFFKNRKCIGEAVTGL

SEQ ID NO: 872254 - protein, 217 aa, Homo sapiens
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMVSCFGPGCFWGTWLRQPSPAPSAWPLFLDGGHRDVGCGPGQIPPHVLQPAGQG

SEQ ID NO: 872255 - protein, 384 aa, Homo sapiens; identical to SEQ ID NO: 872247

SEQ ID NO: 872256 - protein, 355 aa, Homo sapiens
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872257 - protein, 355 aa, Homo sapiens; identical to SEQ ID NO: 872256

SEQ ID NO: 872258 - protein, 372 aa, Homo sapiens
GLFTSRSGAESGSGPGRRSAQRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCTPFLCPFFLCPFLPATLQGGVG

SEQ ID NO: 872259 - protein, 391 aa, Homo sapiens
SGVQRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGAEAQGGAGPSLELPGSLRPWLPPGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 872260 - protein, 290 aa, Homo sapiens
GLFTSRSGAESGSGPGRRSAQRGLQILSTMARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGGGSHQAGDKRLTDCLLSPQR

SEQ ID NO: 872261 - protein, 147 aa, Homo sapiens [sequence omitted]

SEQ ID NO: 872262 - protein, 184 aa, Homo sapiens
SSSTSGCGGGAPPRSGSPVSALPSLSGALQGLPVGTMRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 872263 - protein, 100 aa, Homo sapiens
AAANHWAVGHLMGKKSTGESSSVSERGSLKQQLREYIRWEEAARNLLGLIEAKENRNHQPPQPKALGNQQPSWDSEDSSNFKDLVDSLLQVLNVKEGTPS

SEQ ID NO: 872264 - protein, 373 aa, Homo sapiens
IQHAPRPLQSAGEGVTHVLILLESPARPVAAVTQVQRRRYHRLSDMSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKDLSSRSKTDLDCIFGKRQSKKTPEGDASPSTPEENETTTTSAFTIQEYFAKRMAALKNKPQVPVPGSDISETQVERKRGKKRNKEATGKDVESYLQPKAKRHTEGKPERAEAQERVAKKKSAPAEEQLRGPCWDQSSKASAQDAGDHVQPPEGRDFTLKPKKRRGKKKLQKPVEIAEDATLEETLVKKKKKKDSK

SEQ ID NO: 872265 - protein, 219 aa, Homo sapiens
IQHAPRPLQSAGEGVTHVLILLESPARPVAAVTQVQRRRYHRLSDMSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGRCQSLHSRGERNHDNQRLHHPGVLCQADGSTEEQAPGSSSRV

SEQ ID NO: 872266 - protein, 77 aa, Homo sapiens
GLQGEVPALRRLHMVPCILSEEREEKAAKTSRDSRGRYTRRNASEKEEEERFQMNPSQPGPSDHSAVRALRGQTPLA

SEQ ID NO: 872267 - protein, 373 aa, Homo sapiens; identical to SEQ ID NO: 872264

SEQ ID NO: 872268 - protein, 197 aa, Homo sapiens
IQHAPRPLQSAGEGVTHVLILLESPARPVAAVTQVQRRRYHRLSDMSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKDQIQSKACNNPGFYIYLSELC

SEQ ID NO: 872269 - protein, 257 aa, Homo sapiens
HVCYEWDIVEPGLEEGRKPLTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872270 - protein, 552 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKQTGTRWNLCWELWNTNLVHKGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872271 - protein, 556 aa, Homo sapiens
SWGQVDGTFRVEIFGQENEPQLCSVGCTEFLGVELENVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKQTGTRWNLCWELWNTNLVHKGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872272 - protein, 503 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKQTGTRWNLCWELWNTNLVHKGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQILQLSLTDK

SEQ ID NO: 872273 - protein, 190 aa, Homo sapiens
MLWMCEEFPLSLVEQVIPIIDLMARTSAHFARLRDFIKLEFPPGFPVKIASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872274 - protein, 590 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKQTGTRWNLCWELWNTNLVHKGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872275 - protein, 317 aa, Homo sapiens [sequence omitted]

SEQ ID NO: 872276 - protein, 250 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERYKFRL

SEQ ID NO: 872277 - protein, 261 aa, Homo sapiens [sequence omitted]

SEQ ID NO: 872278 - protein, 128 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMGHPGEPPHQHRRPVPQRPERDKPF

SEQ ID NO: 872279 - protein, 590 aa, Homo sapiens; identical to SEQ ID NO: 872274

SEQ ID NO: 872280 - protein, 365 aa, Homo sapiens
MEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKADRNPLESLLGTVEHQFGAQGGPHHGMCYCKHPTAITPDEYFNEEFDLKDRDIGRPKELTIRTQKFKAMLWMCEEFPLSLVEQVIPIIDLMARTSAHFARLRDFIKLEFPPGFPVKIASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 872281 - protein, 590 aa, Homo sapiens; identical to SEQ ID NO: 872274

SEQ ID NO: 872282 - protein, 590 aa, Homo sapiens; identical to SEQ ID NO: 872274

SEQ ID NO: 872283 - protein, 332 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKADRNPLESLLGTVEHQFGAQGGPHHGMCYCKQPHSHHA

SEQ ID NO: 872284 - protein, 272 aa, Homo sapiens [sequence omitted]

SEQ ID NO: 872285 - protein, 183 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEGE

SEQ ID NO: 872286 - protein, 147 aa, Homo sapiens
SRQQTADSLTSKHRGLGVAHRTPERRPPSRSPVNVPKTTAGSKSTGRTAPLTQAAHPPGGGSASVLRSPPPAPGGRPPGQVRRRPPPRRLPELRRTDSLLLRAANATLEAPSRSAFRRRRVLSSFYSLNIYRGLERWFKPVIPALWE

SEQ ID NO: 872287 - protein, 1402 aa, Homo sapiens
GCRQPKFMYPICTVVVDGLPSESSSSSYPGPVSVSEMSLLHALGPVQTWLGQELEKCGIDAMIYTRYVLSLLLHDSYDYDLQEQENDIFLGWEKGAYKKWGKSKKKCSDLTLEEMKKQNAVQCLRSASDESSGIETLVEELCSRLKDLQSKQEEKIHKKLEGSPSPEAELSPPAKDQVEMYYEAFPPLSEKPVCLQEIMTVWNKSKVCSYSSSSSSSTAPPASTDTSSPKDCNSESEVTKERSSEVPTTVHEKTQSKSKNEKENKFSNGTIEEKPALYKKQIRHKPEGKIRPRSWSSGSSEAGSSSSGNQGELKASMKYVKVRHKAREIRNKKGRNGQSRLSLKHGEKAERNIHTGSSSSSSSGSVKQLCKRGKRPLKEIGRKDPGSTEGKDLYMENRKDTEYKEEPLWYTEPIAEYFVPLSRKSKLETTYRNRQDTSDLTSEAVEELSESVHGLCISNNNLHKTYLAAGTFIDGHFVEMPAVINEDIDLTGTSLCSLPEDNKYLDDIHLSELTHFYEVDIDQSMLDPGASETMQGESRILNMIRQKSKENTDFEAECCIVLDGMELQGERAIWTDSTSSVGAEGLFLQDLGNLAQFWECCSSSSGDADGESFGGDSPVRLSPILDSTVLNSHLLAGNQELFSDINEGSGINSCFSVFEVQCSNSVLPFSFETLNLGNENTDSSANMLGKTQSRLLIWTKNSAFEENEHCSNLSTRTCSPWSHSEETRSDNETLNIQFEESTQFNAEDINYVVPRVSSNYVDEELLDFLQDETCQQNSRTLGEIPTLVFKKTSKLESVCGIQLEQKTENKNFETTQVCNESPHGDGYSSGVIKDIWTKMADTNSVATVEIERTDAELFSADVNNYCCCLDAEAELETLQEPDKAVRRSEYHLWEGQKESLEKRAFASSELSNVDGGDYTTPSKPWDVAQDKENTFILGGVYGELKTFNSDGEWAVVPPSHTKGSLLQCAASDVVTIAGTDVFMTPGNSFAPGHRQLWKPFVSFEQNDQPKSGENGLNKGFSFIFHEDLLGACGNFQVEDPGLEYSFSSFDLSNPFSQVLHVECSFEPEGIASFSPSFKPKSILCSDSDSEVFHPRICGVDRTQYRAIRISPRTHFRPISASELSPGGGSESEFESEKDEANIPIPSQVDIFEDPQADLKPLEEDAEKEGHYYGKSELESGKFLPRLKKSGMEKSAQTSLDSQEESTGILSVGKQNQCLECSMNESLEIDLESSEANCKIMAQCEEEINNFCGCKAGCQFPAYEDNPVSSGQLEEFPVLNTDIQGMNRSQEKQTWWEKALYSPLFPASECEECYTNAKGESGLEEYPDAKETPSNEERLLDFNRVSSVYEARCTGERDSGAKSDGFRGKMCSSASSTSEETGSEGGGEWVGPSEEELFSRTHL

SEQ ID NO: 872288 - protein, 687 aa, Homo sapiens
LGTLMAFRPEETRSDNETLNIQFEESTQFNAEDINYVVPRVSSNYVDEELLDFLQDETCQQNSRTLGEIPTLVFKKTSKLESVCGIQLEQKTENKNFETTQVCNESPHGDGYSSGVIKDIWTKMADTNSVATVEIERTDAELFSADVNNYCCCLDAEAELETLQEPDKAVRRSEYHLWEGQKESLEKRAFASSELSNVDGGDYTTPSKPWDVAQDKENTFILGGVYGELKTFNSDGEWAVVPPSHTKGSLLQCAASDVVTIAGTDVFMTPGNSFAPGHRQLWKPFVSFEQNDQPKSGENGLNKGFSFIFHEDLLGACGNFQVEDPGLEYSFSSFDLSNPFSQVLHVECSFEPEGIASFSPSFKPKSILCSDSDSEVFHPRICGVDRTQYRAIRISPRTHFRPISASELSPGGGSESEFESEKDEANIPIPSQVDIFEDPQADLKPLEEDAEKEGHYYGKSELESGKFLPRLKKSGMEKSAQTSLDSQEESTGILSVGKQNQCLECSMNESLEIDLESSEANCKIMAQCEEEINNFCGCKAGCQFPAYEDNPVSSGQLEEFPVLNTDIQGMNRSQEKQTWWEKALYSPLFPASECEECYTNAKGESGLEEYPDAKETPSNEERLLDFNRVSSVYEARCTGERDSGAKSDGFRGKMCSSASSTSEETGSEGGGEWVGPSEEELFSRTHL

SEQ ID NO: 872289 - protein, 580 aa, Homo sapiens
GCRQPKFMYPICTVVVDGLPSESSSSSYPGPVSVSEMSLLHALGPVQTWLGQELEKCGIDAMIYTRYVLSLLLHDSYDYDLQEQENDIFLGWEKGAYKKWGKSKKKCSDLTLEEMKKQNAVQCLRSASDESSGIETLVEELCSRLKDLQSKQEEKIHKKLEGSPSPEAELSPPAKDQVEMYYEAFPPLSEKPVCLQEIMTVWNKSKVCSYSSSSSSSTAPPASTDTSSPKDCNSESEVTKERSSEVPTTVHEKTQSKSKNEKENKFSNGTIEEKPALYKKQIRHKPEGKIRPRSWSSGSSEAGSSSSGNQGELKASMKYVKVRHKAREIRNKKGRNGQSRLSLKHGEKAERNIHTGSSSSSSSGSVKQLCKRGKRPLKEIGRKDPGSTEGKDLYMENRKDTEYKEEPLWYTEPIAEYFVPLSRKSKLETTYRNRQDTSDLTSEAVEELSESVHGLCISNNNLHKTYLAAGTFIDGHFVEMPAVINEDIDLTGTSLCSLPEDNKYLDDIHLSELTHFYEVDIDQSMLDPGASETMQGESRILNMIRQKSKENTDFEAECCIVLGLPGQVDLTQGASSSPSS

SEQ ID NO: 872290 - protein, 1257 aa, Homo sapiens
IPRTSKQEEKIHKKLEGSPSPEAELSPPAKDQVEMYYEAFPPLSEKPVCLQEIMTVWNKSKVCSYSSSSSSSTAPPASTDTSSPKDCNSESEVTKERSSEVPTTVHEKTQSKSKNEKENKFSNGTIEEKPALYKKQIRHKPEGKIRPRSWSSGSSEAGSSSSGNQGELKASMKYVKVRHKAREIRNKKGRNGQSRLSLKHGEKAERNIHTGSSSSSSSGSVKQLCKRGKRPLKEIGRKDPGSTEGKDLYMENRKDTEYKEEPLWYTEPIAEYFVPLSRKSKLETTYRNRQDTSDLTSEAVEELSESVHGLCISNNNLHKTYLAAGTFIDGHFVEMPAVINEDIDLTGTSLCSLPEDNKYLDDIHLSELTHFYEVDIDQSMLDPGASETMQGESRILNMIRQKSKENTDFEAECCIVLDGMELQGERAIWTDSTSSVGAEGLFLQDLGNLAQFWECCSSSSGDADGESFGGDSPVRLSPILDSTVLNSHLLAGNQELFSDINEGSGINSCFSVFEVQCSNSVLPFSFETLNLGNENTDSSANMLGKTQSRLLIWTKNSAFEENEHCSNLSTRTCSPWSHSEETRSDNETLNIQFEESTQFNAEDINYVVPRVSSNYVDEELLDFLQDETCQQNSRTLGEIPTLVFKKTSKLESVCGIQLEQKTENKNFETTQVCNESPHGDGYSSGVIKDIWTKMADTNSVATVEIERTDAELFSADVNNYCCCLDAEAELETLQEPDKAVRRSEYHLWEGQKESLEKRAFASSELSNVDGGDYTTPSKPWDVAQDKENTFILGGVYGELKTFNSDGEWAVVPPSHTKGSLLQCAASDVVTIAGTDVFMTPGNSFAPGHRQLWKPFVSFEQNDQPKSGENGLNKGFSFIFHEDLLGACGNFQVEDPGLEYSFSSFDLSNPFSQVLHVECSFEPEGIASFSPSFKPKSILCSDSDSEVFHPRICGVDRTQYRAIRISPRTHFRPISASELSPGGGSESEFESEKDEANIPIPSQVDIFEDPQADLKPLEEDAEKEGHYYGKSELESGKFLPRLKKSGMEKSAQTSLDSQEESTGILSVGKQNQCLECSMNESLEIDLESSEANCKIMAQCEEEINNFCGCKAGCQFPAYEDNPVSSGQLEEFPVLNTDIQGMNRSQEKQTWWEKALYSPLFPASECEECYTNAKGESGLEEYPDAKETPSNEERLLDFNRVSSVYEARCTGERDSGAKSDGFRGKMCSSASSTSEETGSEGGGEWVGPSEEELFSRTHL

SEQ ID NO: 872291 - protein, 180 aa, Homo sapiens
GCRQPKFMYPICTVVVDGLPSESSSSSYPGPVSVSEMSLLHALGPVQTWLGQELEKCGIDAMIYTRYVLSLLLHDSYDYDLQEQENDIFLGWEKGAYKKWGKSKKKCSDLTLEEMKKQNAVQCLRSASDESSGIETLVEELCSRLKDLQSKQEEKIHKKLEGSPSPEAEAGSASCFCHQE

SEQ ID NO: 872292 - protein, 756 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 872293 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 872294 - protein, 517 aa, Homo sapiens
MDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 872295 - protein, 370 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETVHSSLGDRARLRLKKKAKTNQQQKPLTVRQAGSGDVALSALGKNSTSR

SEQ ID NO: 872296 - protein, 753 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETTPIRYPNG

SEQ ID NO: 872297 - protein, 326 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDDLP

SEQ ID NO: 872298 - protein, 773 aa, Homo sapiens; identical to SEQ ID NO: 872293

SEQ ID NO: 872299 - protein, 640 aa, Homo sapiens
NVRLVRAGGESAEAKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 872300 - protein, 433 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 872301 - protein, 461 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEVGTCWGGPGAPPPGHSLRAARHRHSTAPALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 872302 - protein, 305 aa, Homo sapiens
MVKEIKDLVALRCCADEACPTCARPHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 872303 - protein, 433 aa, Homo sapiens; identical to SEQ ID NO: 872300

SEQ ID NO: 872304 - protein, 520 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLTPQDLRSALQGRAGGQQGPGAALPPRPPGSARGLLTSQPRAEPSRAGVGGGRRPPCTLCGDYWPRPWPRAPQGAQRRPAAPPQTSWRVWRPGS

SEQ ID NO: 872305 - protein, 415 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGGEEASEAGLRAERGLQKSEGSDLSGEEALSAGAAVVPEEELRALA

SEQ ID NO: 872306 - protein, 294 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCQGRAGGQQGPGAALPPRPPGSARGLLTSQPRAEPSRAGVGGGRRPPCTLCGDYWPRPWPRAPQGAQRRPAAPPQTSWRVWRPGS

SEQ ID NO: 872307 - protein, 203 aa, Homo sapiens [sequence omitted]

SEQ ID NO: 872308 - protein, 113 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEVWLAGVGAGPGQSRC

SEQ ID NO: 872309 - protein, 433 aa, Homo sapiens; identical to SEQ ID NO: 872300

SEQ ID NO: 872310 - protein, 433 aa, Homo sapiens; identical to SEQ ID NO: 872300

SEQ ID NO: 872311 - protein, 433 aa, Homo sapiens; identical to SEQ ID NO: 872300

SEQ ID NO: 872312 - protein, 375 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 872313 - protein, 309 aa, Homo sapiens
MYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 872314 - protein, 433 aa, Homo sapiens; identical to SEQ ID NO: 872300

SEQ ID NO: 872315 - protein, 148 aa, Homo sapiens
MAGATDVVEGTLLPRPSAGGSAPGGASQSCWGAAFQAGYTWACPGGGHGLGSSCKCVPVVGASQVPVALGLRPSAQATLAVSLPGQVPEEEASHNGQRRGLPKAVCMNGTEAAQLSTKSRAEGRAPNPARKACSASSKIRRLSACKQQ

SEQ ID NO: 872316 - protein, 283 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGCVRGAGALPERWPPCFCADHAPGPPERPAGPGRGTAGTGRSPPPSAARQCTRLVDFAAPGGAFPGGRGRREAASMHFMWRLLAPPVASCSAGRPAPSGGPAADQLAGVETRLLTPPCMQRHLEAARPL

SEQ ID NO: 872317 - protein, 129 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKKYGLLGSGPGRASHGADGSVFLPSFSFFRKKE

SEQ ID NO: 872318 - protein, 104 aa, Homo sapiens
SRVGAEHPSLQVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 872319 - protein, 107 aa, Homo sapiens
WPFETLNYNCDSPVSTWLGRPQNHGRRQKAFLTWWRQEKNEVEAKVETPDKPISDLVRLTIMRITWERLVPMIQLPPPGSHLQHVGILGDRIQVEIWVRTQRNHVRG

SEQ ID NO: 872320 - protein, 404 aa, Homo sapiens
MYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 872321 - protein, 597 aa, Homo sapiens
AGGPGPTTPAARRYWPQVCSGPAKLATWKLLPGSGGGSLLLPTAVPGMAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 872322 - protein, 199 aa, Homo sapiens [sequence omitted]

SEQ ID NO: 872323 - protein, 131 aa, Homo sapiens
RRGRQEGGGDVKRPSQPSPPATPTPTRQPSRDAWSGRWGEKARLLWVLPIASSSFSLSRQLRRRGARPGSASGRSRDPQPGARARAMQAPRAAPAAPLSYDRRLRGSSAGPSSLGSHSRCSRGSLRCCRLL

SEQ ID NO: 872324 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 872325 - protein, 227 aa, Homo sapiens
SHLSPFTDQLCWEDAEINDQRPGVRELPPEVAGGEKGEEELKLRRRFPRKWMLPKDVRKGDGNVRIGGGGTNALRRASGLPHHLLQGSGRKAKIAPGHPRESASFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 872326 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 872327 - protein, 112 aa, Homo sapiens; identical to SEQ ID NO: 872326

SEQ ID NO: 872328 - protein, 112 aa, Homo sapiens; identical to SEQ ID NO: 872326

SEQ ID NO: 872329 - protein, 141 aa, Homo sapiens; identical to SEQ ID NO: 872324

SEQ ID NO: 872330 - protein, 141 aa, Homo sapiens; identical to SEQ ID NO: 872324

SEQ ID NO: 872331 - protein, 131 aa, Homo sapiens; identical to SEQ ID NO: 872323

SEQ ID NO: 872332 - protein, 141 aa, Homo sapiens; identical to SEQ ID NO: 872324

SEQ ID NO: 872333 - protein, 159 aa, Homo sapiens
MPPPPALFFQPSPPTPHLPDSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 872334 - protein, 131 aa, Homo sapiens; identical to SEQ ID NO: 872323

SEQ ID NO: 872335 - protein, 222 aa, Homo sapiens
GSANFLALSAGAFSKAPQSSTSWGGSCRIKPAETPFLLTVPATAASASASQPLSEGKDKMKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 872336 - protein, 222 aa, Homo sapiens; identical to SEQ ID NO: 872335

SEQ ID NO: 872337 - protein, 153 aa, Homo sapiens [sequence omitted]

SEQ ID NO: 872338 - protein, 296 aa, Homo sapiens
RLRLVLLTGCAPCPQHRRGLGNGPRAAEPTYWCHGSPKDSSCGAVGGSGGPGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCWGTNVLH

SEQ ID NO: 872339 - protein, 658 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMHYGCASGYSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSKQTTGSGNQFNRPSELSEVKATFAI

SEQ ID NO: 872340 - protein, 661 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMHYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 872341 - protein, 173 aa, Homo sapiens
MFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 872342 - protein, 318 aa, Homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 872343 - protein, 111 aa, Homo sapiens [sequence omitted]

SEQ ID NO: 872344 - protein, 135 aa, Homo sapiens
WAGEGWRELGTLQMAGWVLSAMGLPPSSKCGPEGRSCSPSIARRNQFLVPGSAQEVYIGGHECRAAQLASDPLSTEPSGWGWGCPPQQSSLPEMRWWRRGQSLEFLFGDFPEACSDIKSQQQQSVFKQRDFSGHL

SEQ ID NO: 872345 - protein, 62 aa, Homo sapiens
MTYQSFFPSRDEKNQSIIVSGESGAGKTVSAKYAMRYFATVGGSASETNIEEKVLASSPIME

SEQ ID NO: 872346 - protein, 157 aa, Homo sapiens
VCHPLHYTVIMNPQLCGLLVLGSWCISVMGSLLETLTVLRLSFCTEMEIPHFFCDLLEVLKLACSDTFINNVVIYFATGVLGVISFTGIFFSYYKIVFSILRISSAGRKHKAFSTCGSHLSVVTLFYGTGFGVYLSSAATPSSRTSLVASVMYTMVT

SEQ ID NO: 872347 - protein, 261 aa, Homo sapiens
MELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872348 - protein, 387 aa, Homo sapiens
LWVISRIPRIDGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALENEINNKKKEERDRLQLKAQELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872349 - protein, 188 aa, Homo sapiens
MSIITGITIKLYLFLFKKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872350 - protein, 229 aa, Homo sapiens
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQVRRGKWIHTLTSLLQNISSYYTSLPRF

SEQ ID NO: 872351 - protein, 373 aa, Homo sapiens
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872352 - protein, 368 aa, Homo sapiens
LWVISRIPRIDGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872353 - protein, 306 aa, Homo sapiens
LPVTVVLVKLEALVCQGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872354 - protein, 265 aa, Homo sapiens
MGVRLRSLDFILTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 872355 - protein, 465 aa, Homo sapiens [sequence omitted]

SEQ ID NO: 872356 - protein, 464 aa, Homo sapiens
MPRPRSQLPQPNSQVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 872357 - protein, 149 aa, Homo sapiens
GGVRTGMPRAGMGASLRPGTGPHPDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 872358 - protein, 288 aa, Homo sapiens
MLDDRARMEAAKKEKVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQL

SEQ ID NO: 872359 - protein, 442 aa, Homo sapiens
GTRIEKTGEHFRLVYDTKGRFAVHRITVEEAKYKLCKVRKITVGVKGIPHLVTHDARTIRYLDDRILASCRIRHEWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 872360 - protein, 368 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872361 - protein, 206 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPRHSARHRP

SEQ ID NO: 872362 - protein, 388 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872363 - protein, 361 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872364 - protein, 223 aa, Homo sapiens
MGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872365 - protein, 341 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872366 - protein, 388 aa, Homo sapiens; identical to SEQ ID NO: 872362

SEQ ID NO: 872367 - protein, 388 aa, Homo sapiens; identical to SEQ ID NO: 872362

SEQ ID NO: 872368 - protein, 388 aa, Homo sapiens; identical to SEQ ID NO: 872362

SEQ ID NO: 872369 - protein, 388 aa, Homo sapiens; identical to SEQ ID NO: 872362

SEQ ID NO: 872370 - protein, 388 aa, Homo sapiens; identical to SEQ ID NO: 872362

SEQ ID NO: 872371 - protein, 383 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHLQKTLSPAEDECVIPPLEKLRSGLGGKPICKEGSDGG

SEQ ID NO: 872372 - protein, 104 aa, Homo sapiens
GGGGSGAGGAEGGAGGAGRARERAESGRPCGRRRRHPQAEPARKEFQGDGAAAGADALTAGKSAEPAPGGEGGERGEESASERESERAPGRGPGARGSSGEPER

SEQ ID NO: 872373 - protein, 160 aa, Homo sapiens
MGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNVSLLSNNLHIRHHNKS

SEQ ID NO: 872374 - protein, 215 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGGDTPILGRMPDTL

SEQ ID NO: 872375 - protein, 377 aa, Homo sapiens
MARQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872376 - protein, 251 aa, Homo sapiens
MPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 872377 - protein, 388 aa, Homo sapiens; identical to SEQ ID NO: 872362

SEQ ID NO: 872378 - protein, 388 aa, Homo sapiens; identical to SEQ ID NO: 872362

SEQ ID NO: 872379 - protein, 388 aa, Homo sapiens; identical to SEQ ID NO: 872362

SEQ ID NO: 872380 - protein, 143 aa, Homo sapiens
MAMTWDMETVTSAFWSRDPRISVIVCTGLGGWSSGFLCFFSLFVLSQRWDTDQNCSVYAWDWMERLWSSCGGWGDTDNQTDVLAPVLFLLSKTNKPDSGACPLPGGCSWPHSPHHPTETFVSCPGRHPNSLYIDMPFSFLPPL

SEQ ID NO: 872381 - protein, 388 aa, Homo sapiens; identical to SEQ ID NO: 872362

SEQ ID NO: 872382 - protein, 298 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNVSLLSNNLHIRHHNKS

SEQ ID NO: 872383 - protein, 113 aa, Homo sapiens [sequence omitted]

SEQ ID NO: 872384 - protein, 791 aa, Homo sapiens
RYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 872385 - protein, 791 aa, Homo sapiens; identical to SEQ ID NO: 872384

SEQ ID NO: 872386 - protein, 739 aa, Homo sapiens
RYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQQSFLIQENNNTNHTHSHTHTYTETLSFFLYICVNNDRMEWGKSVF

SEQ ID NO: 872387 - protein, 46 aa, Homo sapiens
GSKPGERERRSVGQYRGRAGLCLLRWPQGMREKEGAGEAGKAWRMQ

SEQ ID NO: 872388 - protein, 137 aa, Homo sapiens
VLAPRPKRATASALGTESPRFLDRPDFFDYPDSDQARLLAVAQFIGEKPIVFINSGSSPGLFHHILVGLLVVAFFFLLFQFCTHIIVGGKEKTRRCPQTKRHRYSAKISPGQGQPSVKGKMQSKRSQGQRKFHVLGE

SEQ ID NO: 872389 - protein, 523 aa, Homo sapiens
RFEQSRQAGYSGFVAAWLHTWAAVGIPTGNSSYWCAAATLKDRVAAEAKDRELMEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 872390 - protein, 471 aa, Homo sapiens
RFEQSRQAGYSGFVAAWLHTWAAVGIPTGNSSYWCAAATLKDRVAAEAKDRELMEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVSEE

SEQ ID NO: 872391 - protein, 170 aa, Homo sapiens
RVLEAFGSGSHTARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 872392 - protein, 118 aa, Homo sapiens
RFEQSRQAGYSGFVAAWLHTWAAVGIPTGNSSYWCAAATLKDRVAAEAKDRELMEFAAENEGKSGGGLHSVAEGVRLSPEPGREGVRDLAGAEEFGGGEEGTGLTGIKEIGDGEEGMV

SEQ ID NO: 872393 - protein, 1166 aa, Homo sapiens
MDQTQNKPTPLGTMLKNFKKGFNGDYGVTMTPGKLRTLCEIDWPTLEVGWPSEGSLDRSLVSKVWHKVTSKSGHSDQFPYIDTWLQLVLDPPQWLRGQAAAVLVAKGQIVKEGFCSTRCGKSTPEVLFDQTSEDPLQEMAPVIPVLPSPYQGERLPTFESTVLAPLPDKCIPRPLRVDKRGGEASGETPPLAAHLRPKTGIQMPLREQQYTGIDEDGHMVESRVFVYQPFTSADLLNWKNNTPSYTEKPQALIDLLQTIIQTHNPTWADCHQLLMFLFKTDERRRVLQAATKWLEEHALADYQNPQEYVRTQLPGTDPQWDPNEREDMQRLNRYRKALLEGLKRRAQKATNINKVSEVIQGKEESPAKFYERLCEAYCMYTPFDPDSPENQRMINMALVSQSTEDIRRKLQKKAGFAGMNTSQLLEIANQVFVNRDAASRKENHIENERQARRNADLLAAAIRGVPPKEAREKGGPGKETQPGCQSLQCNQCAYRKEIGYWKNKCPQLKGKQGDSEQEAPDKEEGALLNLAEGLLDRGGLGSRTSKEPMVRMTVGGKDIDFLVDTSAEHSVVTASVAPLSKKTIDIIGAMGVSAKQAFCLPQTCTIGGHKVIHQFLYMPDCPLPLLGRDLLSKLRATISFTEHGSLLLKLPGTGVIMTLMLPREEEWRLFLTEPGQEIRPALAKRWPRVWAEDNPPGLAVNQAPVLIEVKPGVQPVRQKQYPVLREALEGIQVHLKCLRTFRIIVPCQSPWNTPLLPVPKPGTKDYRPVQDLRLVNQATVTLHPTVPNLYTLLGLLPAEDSWFTCLDLKDAFFSIRLAPERQKLFAFQWEDPESGVTTQYTWTQLPQRFKNSPTIFGEALARDLQKFPTRDLGCVLLQYVDDLLLGHPTAVGCAKGTDALLRHLEDCGYKVSKKKSSDLPTAGMLLGIYYPTGGAQPGSERKQVICNLPEPKTRRQVREFLGAVGFCRLWIPNFAVLAKPLYEVTKAGDQEPFEWGSQQQQAFHELKERLMSVPALGLPDLTKPFTLYVSESEKMAVGVLTQTVGPWLRPVAYLSKQLDGVSKGWPPCLRALAATALLVQEADKLILGQNLNIKDPHAVVTLMNTRGHHWLTNARLTKYQSLLCENPHITIEVCNTLNPATLLPVLEIPVEHDCVEVLDSVYSGHQ

SEQ ID NO: 872394 - protein, 87 aa, Homo sapiens
MAAQITQRKWEAAHEAEQQTAYLEGRCVEWLRRYLENRKETLQHTCTRDHGRLPDRLLSPGLASHKDGRQMGPTLEYHPPSGPEGEE

SEQ ID NO: 872395 - protein, 209 aa, Homo sapiens
QPGKKLKHFGQGYTTRNTGTRPGGGFGLAVQARPLRRGPACSAPARVLGRPVAPRLPGAEGQPARRRRLPGPPSARRRWRPRVARHFRRVPGWPDDVAESEEEAEEARGAGEAQERAVTATAAAEEAAAGPGPVRLSAPRGCESAAAEAAAAEEAAAGGGVGEPAPGRRGAEDEAAAWRSWRGGGRRAVAAAAAAAPDPGGRARTHVSR

SEQ ID NO: 872396 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 872397 - protein, 589 aa, Homo sapiens; identical to SEQ ID NO: 872396

SEQ ID NO: 872398 - protein, 589 aa, Homo sapiens; identical to SEQ ID NO: 872396

SEQ ID NO: 872399 - protein, 575 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRCAIHSKEIYLLSPSPHQAMDKFSLCCINCNLCLHVFLLLLFFQNKDVWLISNIILLWIYGGI

SEQ ID NO: 872400 - protein, 589 aa, Homo sapiens; identical to SEQ ID NO: 872396

SEQ ID NO: 872401 - protein, 589 aa, Homo sapiens; identical to SEQ ID NO: 872396

SEQ ID NO: 872402 - protein, 589 aa, Homo sapiens; identical to SEQ ID NO: 872396

SEQ ID NO: 872403 - protein, 589 aa, Homo sapiens; identical to SEQ ID NO: 872396

SEQ ID NO: 872404 - protein, 67 aa, Homo sapiens
LAVRPEVLICRPGARDAWSHASVDAWAALKSFRKGLVLVFGCIEGLNKCMYVVCVCVCLLKEDVIHK

SEQ ID NO: 872405 - protein, 465 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEM

SEQ ID NO: 872406 - protein, 589 aa, Homo sapiens; identical to SEQ ID NO: 872396

SEQ ID NO: 872407 - protein, 589 aa, Homo sapiens; identical to SEQ ID NO: 872396

SEQ ID NO: 872408 - protein, 589 aa, Homo sapiens; identical to SEQ ID NO: 872396

SEQ ID NO: 872409 - protein, 545 aa, Homo sapiens
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 872410 - protein, 274 aa, Homo sapiens
ARFGSTYTKIGTIQRRLAWPLRKDDTQIREAFHIFEGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 872411 - protein, 589 aa, Homo sapiens; identical to SEQ ID NO: 872396

SEQ ID NO: 872412 - protein, 589 aa, Homo sapiens; identical to SEQ ID NO: 872396

SEQ ID NO: 872413 - protein, 589 aa, Homo sapiens; identical to SEQ ID NO: 872396

SEQ ID NO: 872414 - protein, 589 aa, Homo sapiens; identical to SEQ ID NO: 872396

SEQ ID NO: 872415 - protein, 203 aa, Homo sapiens
NKHITHQTRSPPAAICCCVIVETEVLKAPVFAGSVSSLSLQGHFQKTVKRMACPAFSTTDTPCMKTPGAQKSCLGPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 872416 - protein, 533 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 872417 - protein, 533 aa, Homo sapiens; identical to SEQ ID NO: 872416

SEQ ID NO: 872418 - protein, 220 aa, Homo sapiens
SSTRSIHLYWSQNIRKQRNKKSKIFSSLVLKICCCVIVETEVLKAPVFAGSVSSLSLQGHFQKTVKRMACPAFSTTDTPCMKTPGAQKSCLGPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 872419 - protein, 413 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPYWPECSLLL

SEQ ID NO: 872420 - protein, 382 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTIRC

SEQ ID NO: 872421 - protein, 533 aa, Homo sapiens; identical to SEQ ID NO: 872416

SEQ ID NO: 872422 - protein, 533 aa, Homo sapiens; identical to SEQ ID NO: 872416

SEQ ID NO: 872423 - protein, 413 aa, Homo sapiens; identical to SEQ ID NO: 872419

SEQ ID NO: 872424 - protein, 533 aa, Homo sapiens; identical to SEQ ID NO: 872416

SEQ ID NO: 872425 - protein, 97 aa, Homo sapiens
HPAPSDFYTRSPFLYPQAASVSTLGPRAGLDSAQSEPRLARGEGAAGRQAGKQDSQLPPSPQSRSSLEREAQASLSRRTCVCSVCAISQGPGCRWNA

SEQ ID NO: 872426 - protein, 1237 aa, Homo sapiens
NLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVPPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPSFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAACALARAVGRAALRLRGGRWAGRDGACALVGPPQGRGSGGSTPRVGCAYALDSAFPFGELGMEDAPPSREATPKGSDEGRSHIPNLRPRPQHLGGILSWDGGNLVPMEEATSRGSGTGRHHLMSPGKAIRWDPDPWDPRPIAKYGNLSSLEGGPWARGRALWSAPLGGLGTGGTRMLVGGPRNTGVPLDICAKNKWGEGGGWDFKSTCALGRPNPGGRGDGSGSPRCPYFPLGVCLSLSPNKPSPHIIEFNTPI

SEQ ID NO: 872427 - protein, 335 aa, Homo sapiens
MLGSGPGAGSWVESSPRAPAPHVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 872428 - protein, 196 aa, Homo sapiens
PTLSQEVPFSPPNQLKMPPRCWGRGLKLGMCPQHLGGILSWDGGNLVPMEEATSRGSGTGRHHLMSPGKAIRWDPDPWDPRPIAKYGNLSSLEGGPWARGRALWSAPLGGLGTGGTRMLVGGPRNTGVPLDICAKNKWGEGGGWDFKSTCALGRPNPGGRGDGSGSPRCPYFPLGVCLSLSPNKPSPHIIEFNTPI

SEQ ID NO: 872429 - protein, 340 aa, Homo sapiens
PSTHLQLIALGTRVGAQRELEALIVLGSPAIVLGFGANLRFLSLSWGPMMLTSMNGRKMPEVCHLRSLAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 872430 - protein, 200 aa, Homo sapiens
MEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 872431 - protein, 185 aa, Homo sapiens
MEQTEVLKPRTLADLIRILHQLFAGDEVNVEEVQAIMEAYESDPTEWAMYAKFDQYRYTRNLVDQGNGSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 872432 - protein, 128 aa, Homo sapiens
MILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 872433 - protein, 200 aa, Homo sapiens; identical to SEQ ID NO: 872430

SEQ ID NO: 872434 - protein, 200 aa, Homo sapiens; identical to SEQ ID NO: 872430

SEQ ID NO: 872435 - protein, 104 aa, Homo sapiens
MLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 872436 - protein, 136 aa, Homo sapiens
LKGAREDEPHRSEPDLCVHRVSSDPGSTALPGAWGYTRNLVDQGNGKFNLMILCWGEGHGSSIHDHTNSHCFLKMLQGNLKETLFAWPDKKSNEMVKKSERVLRENQCAYINDAGVGVEMDSDQGEGCCKYKEEHK

SEQ ID NO: 872437 - protein, 71 aa, Homo sapiens
LGISHGELSHSRAPLCRWVSRRAQLGAQFGRVSEPSFCAQQSHSKIHWRWDCAHSWLPFQAIQQPIVCHSH

SEQ ID NO: 872438 - protein, 109 aa, Homo sapiens
MGYYNKASECFQQAFDTTVELMSMPLMDETKVHYGIAKAHQMMLTVNNYIESADLTSLNYLLSWKESRGNIEPDPVTEEFRGSTVEAVSQNSERLEELSRFPGDQKNET

SEQ ID NO: 872439 - protein, 87 aa, Homo sapiens
NAPTARPAPEPPLNQCRARFVYSSKSLEDPQWKLYLKTQNVWKNSVGFQVIKKMKLKAAFHLTSKQEEIHHVTLDFNTCNRSMLQII

SEQ ID NO: 872440 - protein, 475 aa, Homo sapiens [sequence omitted]

SEQ ID NO: 872441 - protein, 475 aa, Homo sapiens [sequence omitted]

SEQ ID NO: 872442 - protein, 85 aa, Homo sapiens
MGDEHTRAGGRARRRGGVRASLKSLEDPQWKLYLKTQNVWKNSVGFQVIKKMKLKAAFHLTSKQEEIHHVTLDFNTCNRSMLQII

SEQ ID NO: 872443 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 872444 - protein, 314 aa, Homo sapiens; identical to SEQ ID NO: 872443

SEQ ID NO: 872445 - protein, 314 aa, Homo sapiens; identical to SEQ ID NO: 872443

SEQ ID NO: 872446 - protein, 465 aa, Homo sapiens
HEVGSEQSARPMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872447 - protein, 672 aa, Homo sapiens
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872448 - protein, 974 aa, Homo sapiens
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFADSGLCLGSLHPSQASHGLESVCP

SEQ ID NO: 872449 - protein, 1181 aa, Homo sapiens
RRRRRTSGCHCRMQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEVRPGMFLICSPSNQPMYHYSILMNTSILGPQIHDPGYPPLSFLTKAPMSAIPNIDFSFVMNLLTTVIFLEEPEVIPQVSLVPTLALLLGLPIPFGNIGEVMAELFSGGEDSQPHSSALAQASALHLNAQQVGERAGFPGDRARVGMKEDNEPLFCPLTSLSPTFHTYPSSVIPPFPDSGQSWVLDFQVPPFVIPILASAPIYVSDLFPLALTFSLPGVPISSYLLSASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872450 - protein, 917 aa, Homo sapiens
MCRGGRCVNYICLGSFNRLLASFNPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872451 - protein, 756 aa, Homo sapiens
GRVGRPRVRVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872452 - protein, 879 aa, Homo sapiens
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAGDLHL

SEQ ID NO: 872453 - protein, 107 aa, Homo sapiens
FFLFEKNIYPFLLLTHLLAPRGLVERLENDTLLVVAGDHGMTTNGDHGGDSELEVSAALFLYSPTAVFPSTPPEVRPGMFLICSPSNQPMLPLQHPHEYLYFRPPNP

SEQ ID NO: 872454 - protein, 672 aa, Homo sapiens; identical to SEQ ID NO: 872447

SEQ ID NO: 872455 - protein, 672 aa, Homo sapiens; identical to SEQ ID NO: 872447

SEQ ID NO: 872456 - protein, 1101 aa, Homo sapiens
RRRRRTSGCHCRMQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872457 - protein, 1101 aa, Homo sapiens; identical to SEQ ID NO: 872456

SEQ ID NO: 872458 - protein, 1172 aa, Homo sapiens
RRRRRTSGCHCRMQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEVRPGMFLICSPSNQPMLPLQHPHEYLYFEAPKSMILGILHSHFLPEAPMSAIPNIDFSFVMNLLTTVIFLEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 872459 - protein, 981 aa, Homo sapiens
RRRRRTSGCHCRMQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGKYLSSDSLKDNSDVSSAPLVFKEVLLLMFLSLTEGPMPHTTRKVFLVSSLLPAIAKQIDPSCWFPGFMERRDKESSKTPCGNAASS

SEQ ID NO: 872460 - protein, 804 aa, Homo sapiens
RRRRRTSGCHCRMQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQAE

SEQ ID NO: 872461 - protein, 525 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 872462 - protein, 201 aa, Homo sapiens
GWWLQDGLGNMGGWELRLLGAHDLFLSPQYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHQALSSQEGPASKHLGCHGNGMPPSYCMPPTPAEAE

SEQ ID NO: 872463 - protein, 638 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKLWFHHLVTERQRLAATPAGALTVWSLSSTPHLPPSSYDQGNWSLERYSDFTPSGAGACSELSHGRAGFWPCGGLKCYPRGLKVPGTAPKKGLLQASSVPWWLAWLIPTPLSPQGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 872464 - protein, 509 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIR

SEQ ID NO: 872465 - protein, 525 aa, Homo sapiens; identical to SEQ ID NO: 872461

SEQ ID NO: 872466 - protein, 127 aa, Homo sapiens
RPCYLTIFKVQGTDLGSLLLVSHSTLPSWDLPSLSRQPSAMALPVPPSPFFQGAERWPPGVALSYLHSLPLKMGGDQRSMGLACESPLAAWSLGITPALVLQMLLGFIGAGPSRAGPLTLPAWLHSP

SEQ ID NO: 872467 - protein, 525 aa, Homo sapiens; identical to SEQ ID NO: 872461

SEQ ID NO: 872468 - protein, 525 aa, Homo sapiens; identical to SEQ ID NO: 872461

SEQ ID NO: 872469 - protein, 720 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHRKERPHSPPVWKPKNPPGVGGRGAGGGECATREMTVAFVLKWGVWFPRNGMGPLGVGLNFGPQTFGVFFPKNPGGEKHNTQNTTDRRETLFGVLGHPFSFPLFLPFFRFFPSFDHSSPPLGSALLGWGVAPPRRSTPTSSLAFSFSFPRQKFFWCAVGIKKNPPFVGVHPALFYTAPVFKRGPGYKSAISSNGPPK

SEQ ID NO: 872470 - protein, 544 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHSERGAAGRRGDPQREGSGRYPTGQNAECGGHLFVSLTRSLPNIEQGSQPAPLRSGEGLPYSISLRVILCPSCCATWS

SEQ ID NO: 872471 - protein, 337 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEASCGGSHL

SEQ ID NO: 872472 - protein, 299 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKRWSFTLAAQAGV

SEQ ID NO: 872473 - protein, 425 aa, Homo sapiens
ADGMHGREAGPFVCVCVLLASIPTPQTPLLQASLPPFHPASAGHPITGQQDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 872474 - protein, 525 aa, Homo sapiens; identical to SEQ ID NO: 872461

SEQ ID NO: 872475 - protein, 525 aa, Homo sapiens; identical to SEQ ID NO: 872461

SEQ ID NO: 872476 - protein, 122 aa, Homo sapiens
MLDLSPFLLSFFSSHLPHSTLPSWDLPSLSRQPSAMALPVPPSPFFQGAERWPPGVALSYLHSLPLKMGGDQRSMGLACESPLAAWSLGITPALVLQMLLGFIGAGPSRAGPLTLPAWLHSP

SEQ ID NO: 872477 - protein, 525 aa, Homo sapiens; identical to SEQ ID NO: 872461

SEQ ID NO: 872478 - protein, 544 aa, Homo sapiens; identical to SEQ ID NO: 872470

SEQ ID NO: 872479 - protein, 544 aa, Homo sapiens; identical to SEQ ID NO: 872470

SEQ ID NO: 872480 - protein, 385 aa, Homo sapiens
GGRGPLGGTGKPGILRQEGRDTPERRREGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEGRGKSCSSSAGRQDFRGSSLVANRLAHVEKTLFGESSSCTLGGASTWLGPICFTSG

SEQ ID NO: 872481 - protein, 46 aa, Homo sapiens
KGAIPRFSVISNAYPGSTTKKTTQGAMSLSRSHRVQKLLSFKQVVI

SEQ ID NO: 872482 - protein, 703 aa, Homo sapiens
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 872483 - protein, 720 aa, Homo sapiens
MADRRRQRASQDTEDEESGASGSDSGGSPLRGGGSCSGSAGGGGSGSLPSQRGGRTGALHLRRVESGGAKSAEESECTVKMALKGDAGLSDYEGAERIGKRKFAVFGDKLLENCSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 872484 - protein, 612 aa, Homo sapiens
MICAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 872485 - protein, 564 aa, Homo sapiens [sequence omitted]

SEQ ID NO: 872486 - protein, 132 aa, Homo sapiens
MLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 872487 - protein, 85 aa, Homo sapiens
IEQCGRVGSAEGRGAALLGKGSYLSSLSMALNHFSAASVEEIPITAVHTSARGNLATVPVLLQNLRAKMVAVSLPGNVTVFIPSI

SEQ ID NO: 872488 - protein, 703 aa, Homo sapiens; identical to SEQ ID NO: 872482

SEQ ID NO: 872489 - protein, 851 aa, Homo sapiens
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSVNTSPEYMKILTSSKQEVTNQKRHTRWISTNKKGCKDIQERHLTTKQRHTGTPDSYGRQDHNEGKTKGHGPSTDDVKARRRRKRKRTQARRRAHKPSPNERRRQIGTKEASVPRDAPRDTTQQTQEKTRLHTTTKKTRDRRRRCRRINE

SEQ ID NO: 872490 - protein, 534 aa, Homo sapiens
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMLTLQISIKYLPCTKCFSTPKGR

SEQ ID NO: 872491 - protein, 633 aa, Homo sapiens [sequence omitted]

SEQ ID NO: 872492 - protein, 108 aa, Homo sapiens
TRHRYEAGLSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 872493 - protein, 703 aa, Homo sapiens; identical to SEQ ID NO: 872482

SEQ ID NO: 872494 - protein, 87 aa, Homo sapiens
ESLPQRQQRSGLVPWIGRKDRSPCPEGDWLPALNHFSAASVEEIPITAVHTSARGNLATVPVLLQNLRAKMVAVSLPGNVTVFIPSI

SEQ ID NO: 872495 - protein, 101 aa, Homo sapiens
LQGSPISGVGLGMVTPAGCLEGENQGPRKIPDTAFPPSSRAGQTRQVVSGAQVSSWRECQPCSGSPSCILGTDANVGTAGKLGLVPLPGFRKKPNKELSAE

SEQ ID NO: 872496 - protein, 101 aa, Homo sapiens; identical to SEQ ID NO: 872495

SEQ ID NO: 872497 - protein, 68 aa, Homo sapiens
DRAGLMAKATAGEGGTLISQAFDLQILAGELRCRIWVPENLLWPRRRGGVDQMGKDGDLYCPSNERAG

SEQ ID NO: 872498 - protein, 126 aa, Homo sapiens
LLGEASLTSPLALIPPSEPQHSPSKSRALCNRGLRSTSRCTQQGLPSVPPSPLTPLPPSPTAPRRSQYPSPGSRVGRGLGTGRGKLAHRVAPSKEPPERACGSRGRSTGWAASSPKTHAAGQAPAA

SEQ ID NO: 872499 - protein, 133 aa, Homo sapiens
SCRYMVRVRAVVMARDDSSGGWLPVGGGGLSQTTLECTLKPGLVYNKVNPIFHHWSLGDCKFGLTFQSPAEADEFQKSLLAALAALGRGSLTPSSSSSSSSPSQDTAETPCPLTVSVQDASLLGEGRGFVFIL

SEQ ID NO: 872500 - protein, 125 aa, Homo sapiens
SCRYMVRVRAVVMARDDSSGGWLPVGGGGLSQTTLECTLKPGLVYNKVNPIFHHWSLGDCKFGLTFQSPAEADEFQKSLLAALAALGRGSLTPSSSSSSSSPSQDTAETPCPLTLSQYFRHMLCP

SEQ ID NO: 872501 - protein, 255 aa, Homo sapiens
MARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 872502 - protein, 179 aa, Homo sapiens
MTPLMRNRTQRQQMDPLLGRSLGRAGCPRKMNGQQMMQFDSPEWERTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 872503 - protein, 269 aa, Homo sapiens
MARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPWFHWPPCIMRQECMKMPSLPSCKGKDAYPYVASCEVHAPRPASFFFFMVHAKGFPCILECSRPVMNPGGAWAHAGPFHTHAVPWGSPSNHVRHARCKGARAFLASCLPVVTQAQP

SEQ ID NO: 872504 - protein, 255 aa, Homo sapiens; identical to SEQ ID NO: 872501

SEQ ID NO: 872505 - protein, 153 aa, Homo sapiens
MARAKALLGGPGEELEADTEYLDPFDAQPHPAPPDDGYMEPYDAQWVMSELPGRGVQLYDTPYEEQDPETADGPPSGQKPRQSRMPQEGMISPGSGRKTTSPGRLQCSLTVQSGRGLQAQPRSSGDLRPEAPSLRSVWTQPCPWRNSRGFMAP

SEQ ID NO: 872506 - protein, 255 aa, Homo sapiens; identical to SEQ ID NO: 872501

SEQ ID NO: 872507 - protein, 202 aa, Homo sapiens
MSDAAEAPREATGENGETEMKEEEEPNPNYKEVEDPQQESKDDTIAWRESQEEERKTGEEEGEEEEKEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQE

SEQ ID NO: 872508 - protein, 123 aa, Homo sapiens
CLTSPCARLLLSRFPSLPEDLLPLALPRRALPAHEEYLPASHGHYWASLYCRRQWLPCQAAPASAHWHTLFRLCGVPVLTAIFSTLVEWGPIISARAFLVPSLSKVSFRSPVKAALKCFLCQI

SEQ ID NO: 872509 - protein, 116 aa, Homo sapiens
GRVRLSREGFSAEPRRAAGVCCLTRAQLWGDTRGRLLQPRDPALQPAPRLPRARRCLSPAGAMSPALLGRCSRLCAPYLAPVLCLQFHSSRAGWAPPLCTVEEPGHWPISVVKLEV

SEQ ID NO: 872510 - protein, 410 aa, Homo sapiens
MVLKAEHTRSPSATLPSNVPSCRSLSSSEDGPSGPSSLADGGLAHNLQDSVRHRILYLSEQLRVEKASRDGNTVSYLKLVSKADRHQVPHIQQAFEKVNQRASATIAQIEHRLHQCHQQLQELEEGCRPEGLLLMAESDPANCEPPSEKALLSEPPEPGGEDGPVNLPHASRPFILESRFQSLQQGTCLETEDVAQQQNLLLQKVKAELEEAKRFHISLQESYHSLKERSLTDLQLLLESLQEEKCRQALMEEQVNGRLQGQLNEIYNLKHNLACSEERMAYLSYERAKEIWEITETFKSRISKLEMLQQVTQLEAAEHLQSRPPQMLFKFLSPRLSLATVLLVFVSTLCACPSSLISSRLCTCTMLMLIGLGVLAWQRWRAIPATDWQEWVPSRCRLYSKDSGPPADGP

SEQ ID NO: 872511 - protein, 410 aa, Homo sapiens; identical to SEQ ID NO: 872510

SEQ ID NO: 872512 - protein, 137 aa, Homo sapiens
KIMTKTFPCHFVVPKGSPAIPQATVVSFPKTRLTSEPQVIFLPWWTSVAPLLRDEQGLPDKDDSGILLGVKVRNEKSCSLLLIFSVSVISAVATVSSSLLPRAPWRYVYREALSLLSCGSLKPHFPQHHACTCLSRL

SEQ ID NO: 872513 - protein, 112 aa, Homo sapiens
MVEKYSVATQIVMGGVTGWCAGFLFQKVGKLAATAVGGGFLLLQIASHSGYVQIDWKRVEKDVNKAKRQIKKRANKAAPEINNLIEEATEFIKQNIVISSGFVGGFLLGLAS

SEQ ID NO: 872514 - protein, 155 aa, Homo sapiens
MATRNPPPQDYESDDDSYEVLDLTEYARRHQWWNRVFGHSSGPMVEKYSVATQIVMGGVTGWCAGFLFQKVGKLAATAVGGGFLLLQIASHSGYVQIDWKRVEKDVNKAKRQIKKRANKAAPEINNLIEEATEFIKQNIVISSGFVGGFLLGLAS

SEQ ID NO: 872515 - protein, 142 aa, Homo sapiens
MNTTFLVGMIINFSAKTACILGSGKQYISQESELTARYPTSWLPDYCSRFPQEQSSFTGCLAGPRNRVTLVATANRPNTASRQEGQSCSAGCTCRLEADRAGRAQICWLCPTHRCLHTHPSDPGCTLSANPRTLFFLICTDS

SEQ ID NO: 872516 - protein, 108 aa, Homo sapiens
RSSPSGGNQPIHVEVLKSQEPAHRRLPGFESWQVLNSLSLSYSICNRTCLPGIAGKIQGENLGQAIGSQISKSSTGEVPRLGLEPREVRTPGEVRGNPHTGLFHVLFL

SEQ ID NO: 872517 - protein, 218 aa, Homo sapiens; identical to SEQ ID NO: 787569

SEQ ID NO: 872518 - protein, 83 aa, Homo sapiens
LKLKIGTSLNRMLSFSPTAQPRAAKPSMFTEPKGCRRPWKLKIKTGCCKADHLRRILIPDKYPPTSRTGRHMATRASCQNLSL

SEQ ID NO: 872519 - protein, 72 aa, Homo sapiens
GAESMCKGPWTDRIACCCASEAEIPEGELKYGWRVPRIQFAADEYGRLPAGVVAHPQGALVLRRLLISPIPH

SEQ ID NO: 872520 - protein, 544 aa, Homo sapiens
MATAPGPAGIAMGSVGSLLERQDFSPEELRAALAGSRGSRQPDGLLRKGLGQREFLSYLHLPKKDSKSTKNTKRAPRNEPADYATLYYREHSRAGDFSKTSLPERGRFDKCRIRPSVFKPTAGNGKGFLSMQSLASHKGQKLWRSNGSLHTLACHPPLSPGPRASQARAQLLHALSLDEGGPEPEPSLSDSSSGGSFGRSPGTGPSPFSSSLGHLNHLGGSLDRASQGPKEAGPPAVLSCLPEPPPPYEFSCSSAEEMGAVLPETCEELKRGLGDEDGSNPFTQVLEERQRLWLAELKRLYVERLHEVTQKAERSERNLQLQLFMAQQEQRRLRKELRAQQGLAPEPRAPGTLPEADPSARPEEEARWEVCQKTAEISLLKQQLREAQAELAQKLAEIFSLKTQLRGSRAQAQAQDAELVRLREAVRSLQEQAPREEAPGSCETDDCKSRGLLGEAGGSEARDSAEQLRAELLQERLRGQEQALRFEQERRTWQEEKERVLRYQREIQGGYMDMYRRNQALEQELRALREPPTPWSPRLESSKI

SEQ ID NO: 872521 - protein, 81 aa, Homo sapiens
TRDPAPIARQAPTSPCSPLSPHPAGRAPQCSEKPALNSPPPLPGHSLLPAPTAPMPISVSSFCAAVIVGLPVSFELWALPG

SEQ ID NO: 872522 - protein, 104 aa, Homo sapiens [sequence omitted]

SEQ ID NO: 872523 - protein, 104 aa, Homo sapiens [sequence omitted]

SEQ ID NO: 872524 - protein, 112 aa, Homo sapiens
SVLTLKTEVNAKLSSVYKNKPQGHQKTPYLHLLTGIANILPLFCPKSTGDTTNELQHTYFWLRKLPEHSIPSSSSITWRWHKMEPPALSFSHVCMHSCTHAFISWKLQQCPA

SEQ ID NO: 872525 - protein, 111 aa, Homo sapiens
MKTHTCACGGARGAPKMVKRGEQVWPKSAGLPRGEKLRGHKTKGAAEDFSTPNKKKRPRGGNTGERFVETNFRERGGSGGANYGGDLLQRGAFQRETVIIQKLHPAERGMK

SEQ ID NO: 872526 - protein, 104 aa, Homo sapiens
GSHCGSGRLRGPSDPQGRRGFEGTSSRPTWSTWVKKKKKKRHENNHKKGRRGACGRFCRPIVGIGIFFLGKNSVPVSAVLWACHLDDQNESLLCLLPARICGGT

SEQ ID NO: 872527 - protein, 189 aa, Homo sapiens
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 872528 - protein, 216 aa, Homo sapiens
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 872529 - protein, 197 aa, Homo sapiens
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKRLQGAPENPARGGVSTSGVASTLQQVG

SEQ ID NO: 872530 - protein, 176 aa, Homo sapiens
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKEPPAAR

SEQ ID NO: 872531 - protein, 157 aa, Homo sapiens
ICHPFHYTMILTRMLCVKMVVMCHALSHLHAMLHTFLIGQLIFCADNRIPHFFCDLYALMKISCTSTYLNTLMIHTEGAVVISGALAFITASYACIILVVLRIPSAKGRWKTFSTCGSHLTVVAIFYGTLSWVYFRPLSSYSVTKGRIITVVYTVVT

SEQ ID NO: 872532 - protein, 131 aa, Homo sapiens [sequence omitted]

SEQ ID NO: 872533 - protein, 654 aa, Homo sapiens
DDLEVTRKKLVDDCHHFRLEEPNFSLASSNSKDIESCAQIWAFYEEFQQGFQEMANEDWITFRTKTYLFEEFLMNWHVRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRSIMTDIKKDNRVTTLTTHAGIRNSLLTILDQLQRCQRSLNEFLEEKRSAFPRFYFIGDDDLLEILGQSTNPSVIQSHLKKLFAGINSVCFDEKSKHITAMKSLEGEVVPFKNKVPLSNNVETWLNDLALEMKKTLEQLLKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGNASKLVYTPLTDKCYLTLTQAMKMGLGGNPYGPAGTGKTESVKALGGLLGRQVLVFNCDEGIDVKSMGRIFVGLVKCGAWGCFDEFN

SEQ ID NO: 872534 - protein, 524 aa, Homo sapiens
KRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDINSSRTGRKLKFFVDHQPTQNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 872535 - protein, 378 aa, Homo sapiens
KRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPV

SEQ ID NO: 872536 - protein, 549 aa, Homo sapiens
KRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 872537 - protein, 467 aa, Homo sapiens
KRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGF

SEQ ID NO: 872538 - protein, 78 aa, Homo sapiens
MTYSSCLYLFLFFSDLSYFLYSDEHLNLGAPSPTSSRTSSQASLAPHPLGSPGTTSFFMVAKPGPWAPTLPQGEALAG

SEQ ID NO: 872539 - protein, 114 aa, Homo sapiens
QQRNPGDRTASTTTRRRRRRHTALGKSEVLSDHSHHDSRAGRGARKQRWETWRHPKKRLPQKHCCARTCKSLRRLCPMAPAPCSEVAQVSKARRGTEETKKKQHSSWGGRNSRV

SEQ ID NO: 872540 - protein, 81 aa, Homo sapiens
LLRSPLDGSRSDETRLLLVLIDRSNLGLPKCWDYRREPPCLACPWVLEIRELVVTLNEHAAFKHLFNKAHLAQPLIHLTLS

SEQ ID NO: 872541 - protein, 562 aa, Homo sapiens
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 872542 - protein, 581 aa, Homo sapiens [sequence omitted]

SEQ ID NO: 872543 - protein, 434 aa, Homo sapiens
MNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 872544 - protein, 562 aa, Homo sapiens; identical to SEQ ID NO: 872541

SEQ ID NO: 872545 - protein, 562 aa, Homo sapiens; identical to SEQ ID NO: 872541

SEQ ID NO: 872546 - protein, 562 aa, Homo sapiens; identical to SEQ ID NO: 872541

SEQ ID NO: 872547 - protein, 434 aa, Homo sapiens; identical to SEQ ID NO: 872543

SEQ ID NO: 872548 - protein, 562 aa, Homo sapiens; identical to SEQ ID NO: 872541

SEQ ID NO: 872549 - protein, 562 aa, Homo sapiens; identical to SEQ ID NO: 872541

SEQ ID NO: 872550 - protein, 45 aa, Homo sapiens
SRGNKSTIKALIDSVSSEASLPDLWTATFSLCPFMIFPQCMCSER

SEQ ID NO: 872551 - protein, 116 aa, Homo sapiens
MSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKENKSRIDTPPSTNCTHV

SEQ ID NO: 872552 - protein, 349 aa, Homo sapiens
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKENKSRIDTPPSTNCTHV

SEQ ID NO: 872553 - protein, 34 aa, Homo sapiens
MLWGRPADVCCVPAVGHQPSVVSIKFELRKKIKE

SEQ ID NO: 872554 - protein, 68 aa, Homo sapiens
HSAHGPLLYINTCYYNILVHKRVGVLLEFMYLRQQMSNQLKQRLYLIAKNKTGIFPLLINVNPTIFQH

SEQ ID NO: 872555 - protein, 69 aa, Homo sapiens
LLHCQNGGTCHNNVRCLCPAAYTGILCEKLRCEEAGSCGSDSGQGAPPHGSPALLLLTTLLGTASPLVF

SEQ ID NO: 872556 - protein, 275 aa, Homo sapiens
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 872557 - protein, 305 aa, Homo sapiens
MSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 872558 - protein, 314 aa, Homo sapiens
MSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 872559 - protein, 314 aa, Homo sapiens; identical to SEQ ID NO: 872558

SEQ ID NO: 872560 - protein, 266 aa, Homo sapiens
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 872561 - protein, 109 aa, Homo sapiens
MVSGETPDHWRPSSMCQLSPTPASFQQPYFERGTYMSPVIRRLKLASWGRYLLGPPFPLTNPSDFFLTFSSPEPAKRTVLKIPAISIYGVTTVYLCAHPPFHPNLPAQP

SEQ ID NO: 872562 - protein, 495 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 872563 - protein, 391 aa, Homo sapiens [sequence omitted]

SEQ ID NO: 872564 - protein, 307 aa, Homo sapiens [sequence omitted]

SEQ ID NO: 872565 - protein, 378 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGTDPTGSSDTGSITSCPIIHSNTNSPYCHSEPASTTSSSNTACCPGSSPAASSTPAAGSVHPAPANFKSASTTSYSPC

SEQ ID NO: 872566 - protein, 391 aa, Homo sapiens [sequence omitted]

SEQ ID NO: 872567 - protein, 495 aa, Homo sapiens; identical to SEQ ID NO: 872562

SEQ ID NO: 872568 - protein, 135 aa, Homo sapiens
KFLAKYTGHLTKKGKVDLKNSTLLSQFRNLMPRWTPEKQFPAVQGVRKYGKDFQAIADVIGNKTVGQVKNFFVNYRRRFNLEEVLQEWEAEQGTQASNGDASTLGEETKSASNVPSGKSTDEEEEVCLCMEFELI

SEQ ID NO: 872569 - protein, 230 aa, Homo sapiens
MDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 872570 - protein, 211 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEVMMITRSTCDCSTNLLKKNEQYFVLRKTF

SEQ ID NO: 872571 - protein, 77 aa, Homo sapiens
PPELALIRVRPTRSTPRNRPHREEVRWQALGAHSLVLLNSVSKPRLPAADPGHVLQDCSHTSLPTPALALSSLTLLK

SEQ ID NO: 872572 - protein, 141 aa, Homo sapiens [sequence omitted]

SEQ ID NO: 872573 - protein, 682 aa, Homo sapiens
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACAAAGSFGTTLRLSQELHQCCFGKRDRTFCRSLGPWVGSLLLLPPSHFSHLDLGEQSLLPVKSGVTFPHQGQNPPPSLTMGAASLWAASAASLSQGSARPGQLRSQGSRTREGHLQEVGVLRVPQEGEGDMAPTGYQYMSSRLSPDTHRVPGTVSPFSLANPSPWEVAICSARQQERTGQCQRASREQTPNLRDASGVHRHPPPGLCGAPHPTQVVPPGPRGPLAGKPVSREGARKKLDPAGTLVCTAVVSCFSVVSPPRQPPNPLLLFPSLTRHQQVPERPRPQRPCGHCGHHSHDRGPYYSCPLHVHCLGPHGAQHPTAHRWVPGYSDPCHPTLSCF

SEQ ID NO: 872574 - protein, 530 aa, Homo sapiens
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACAAAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 872575 - protein, 88 aa, Homo sapiens
EKDRAGVGWKANVCDDDQLLCQNGGTCLQNQRCACPRGYTGVRCEQPRCDPADDDGGLDCDRAPGAAPRPATLLGCLLLLGLAARLGR

SEQ ID NO: 872576 - protein, 246 aa, Homo sapiens
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEWLKDPGPRTEKRTLCCDMVCFLFITPLAAISGWLCLRGAQDHLRLHSQLEAVGLIALTIALFTIYVLWTLVSFRYHCQLYSEWRKTNQKVRLKIREADSPEGPQHSPLAAGLLKKVAEETPV

SEQ ID NO: 872577 - protein, 246 aa, Homo sapiens; identical to SEQ ID NO: 872576

SEQ ID NO: 872578 - protein, 246 aa, Homo sapiens; identical to SEQ ID NO: 872576

SEQ ID NO: 872579 - protein, 176 aa, Homo sapiens
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEVSFRYHCQLYSEWRKTNQKVRLKIREADSPEGPQHSPLAAGLLKKVAEETPV

SEQ ID NO: 872580 - protein, 202 aa, Homo sapiens
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEWLKDPGPRTEKRTLCCDMVCFLFITPLAAISGWLCLRGAQDHLRLHSQLEAVGLIALTIALFTIYVLWTLVSGCGCAA

SEQ ID NO: 872581 - protein, 143 aa, Homo sapiens
AAGGARTQVPAGAELVAPTGRAGPGPGPRRTEGPVRPPGPAADQGRHGPAGRAGGRQSAGRPRVRGRSSAPGRDGWARSLGHSLLGDAGTSVPVSRPVGGLRGPAHIGASPSLGFPTCETGSSHCQPDGASGRIQEVAGAENA

SEQ ID NO: 872582 - protein, 143 aa, Homo sapiens; identical to SEQ ID NO: 872581

SEQ ID NO: 872583 - protein, 246 aa, Homo sapiens; identical to SEQ ID NO: 872576

SEQ ID NO: 872584 - protein, 76 aa, Homo sapiens
SGGRCPDAGAGRSGASGADGPGRAGTGAEANRGACAAARPGRGSGDWRLGLALLPRLECSGVIIAHYSLELLGSRG

SEQ ID NO: 872585 - protein, 75 aa, Homo sapiens
RSTGKGCLRSCEISRDGLSFVIPQPLSPSSFTQQEYGSLFSVLWTLDTVGSLIVIRKTERISDLMLSKSRLQSPP

SEQ ID NO: 872586 - protein, 70 aa, Homo sapiens
VDRGTNCTLVLVFEFKDGARVDMVGRGTRVLTQQLEELTAPWSSPQSPVHPPSLTFLHSKGYQHCPAQGP

SEQ ID NO: 872587 - protein, 105 aa, Homo sapiens
AWSWLGWAEDHRGKMDGKLDLLGPRMMPMGEEGGSANPPFCPLPSPFSFPSCFGVQTQRRNSSAASRARTHSATVKTTSRSSCRSAAVTCSPVAQQPSAPCVPTS

SEQ ID NO: 872588 - protein, 781 aa, Homo sapiens
AWSWLGWAEDHRGKMDGKLDLLGPRMMPMGEEGGSANPPFCPLTFPFLIPQLLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872589 - protein, 943 aa, Homo sapiens
GPAWQGGRVSGHSRKSGPAGGDDRALTLTHSRSGGGGPRGDSGADRGAELPPVSPAEPPEPEPRDTVAPALRMLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGKCCSPAGSGEGVHVAGGSWAVGSTQGLSPVHTPGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872590 - protein, 400 aa, Homo sapiens
TRRQPQDTDERRARQRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872591 - protein, 382 aa, Homo sapiens
DKGSSHELLESGVACYVTGLLGVALGGIQAGWPWVMALAAHARFSSPCLAVQGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872592 - protein, 318 aa, Homo sapiens
MLTPVGGESAQERPLPRPKSAGGVRECELRGLPGPIPEFSLALRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872593 - protein, 814 aa, Homo sapiens
GPAWQGGRVSGHSRKSGPAGGDDRALTLTHSRSGGGGPRGDSGADRGAELPPVSPAEPPEPEPRDTVAPALRMLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSWARTQLLDLSSLYQAVATREDSASSGEIS

SEQ ID NO: 872594 - protein, 201 aa, Homo sapiens [sequence omitted]

SEQ ID NO: 872595 - protein, 201 aa, Homo sapiens [sequence omitted]

SEQ ID NO: 872596 - protein, 143 aa, Homo sapiens
TPSVPHTSPACRVAFSCTPLSFSPSLLLIPWSAPEPMCPPSCRTWRTSPWQGTRRGMSSWKMARAVVPSTRISSPLPWWLVSVEGRMASLRFHVGAHRARGLALDRLSPCHAYFQGDRMARGLPWVWFFQVPASFSAHHRQNG

SEQ ID NO: 872597 - protein, 832 aa, Homo sapiens
MGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872598 - protein, 909 aa, Homo sapiens
GPAWQGGRVSGHSRKSGPAGGDDRALTLTHSRSGGGGPRGDSGADRGAELPPVSPAEPPEPEPRDTVAPALRMLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872599 - protein, 675 aa, Homo sapiens [sequence omitted]

SEQ ID NO: 872600 - protein, 919 aa, Homo sapiens
GPAWQGGRVSGHSRKSGPAGGDDRALTLTHSRSGGGGPRGDSGADRGAELPPVSPAEPPEPEPRDTVAPALRMLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRVSRPTRNPGRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872601 - protein, 360 aa, Homo sapiens
GSTLTVQGSEAGWPVQNLLLDTHRGLLYAASHSGVVQVPMANCSLYRSCGDCLLARDPYCAWSGSSCKHVSLYQPQLATRILSGLRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 872602 - protein, 909 aa, Homo sapiens; identical to SEQ ID NO: 872598

SEQ ID NO: 872603 - protein, 201 aa, Homo sapiens [sequence omitted]

SEQ ID NO: 872604 - protein, 643 aa, Homo sapiens
GPAWQGGRVSGHSRKSGPAGGDDRALTLTHSRSGGGGPRGDSGADRGAELPPVSPAEPPEPEPRDTVAPALRMLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGKCCSPAGSGEGVHVAGGSWAVGSTQGLSPVHTPGDGRLHKAVSVGPRVHIIEELQIFSSGQPVQNLLLDTHRVSRPTRNPGRVLGGCPPLAPSSPHPASPPL

SEQ ID NO: 872605 - protein, 545 aa, Homo sapiens
MSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 872606 - protein, 708 aa, Homo sapiens
MRVLGGRCGALLACLLLVLPVSEANFFLYFRNDSIYNHTCISVLVGLSGCYFFYSLCFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 872607 - protein, 725 aa, Homo sapiens
AGGGGGGGGGGGRSTAQTEAHRLAAPRRLALRSPPRRATVPAGASARFEMRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 872608 - protein, 676 aa, Homo sapiens
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 872609 - protein, 57 aa, Homo sapiens [sequence omitted]

SEQ ID NO: 872610 - protein, 96 aa, Homo sapiens
KKGQLPRCTSGPHARGPLQAADTALVDMTHLCCRKRTLSPPPPHGGQMPQWGWSRAAQSHALTQIKRNTQSLKRKGVPTPGDKPALAVRPCLHLSV

SEQ ID NO: 872611 - protein, 129 aa, Homo sapiens
MSRRGGEGRGTERAEGEAGARGERADRRGGGRGTGSEQRDSLRRKRWTSEQSGARRGERRDAERGGGVAGRERRDRRARTHNSGRRVSRGTGSEHGDKDGAEDRARASEEERRTRRYGEHTDTSTPNST

SEQ ID NO: 872612 - protein, 134 aa, Homo sapiens
NTCSSVDLKLHDPQTRITSAPLQVSSCSILKREHQLLPESSAARPSNYNISSSPGLQLQDTHTRKIPAPPGFYSCTAIKLKKHQLLSGSPAAGPSNQNIRFSRVLQLPNPQTKETPAPPRVYSCMTLKLKNTSS

SEQ ID NO: 872613 - protein, 732 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 872614 - protein, 757 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGESAGGGGAPALPGEWFLTCLGARTGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 872615 - protein, 303 aa, Homo sapiens
CGARPCSRVEPGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 872616 - protein, 696 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQPS

SEQ ID NO: 872617 - protein, 732 aa, Homo sapiens; identical to SEQ ID NO: 872613

SEQ ID NO: 872618 - protein, 687 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEASSPSSPERPHSRTTRRLGRSTTRSKRKWPPEGVQELPQAPSQTTVPPGRNITDSRPLTTDWSVVFSSVQEEIETENKMRTTKKIVWQFLLFIARF

SEQ ID NO: 872619 - protein, 696 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 872620 - protein, 694 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEASSPSSPERPHSRTTRRLGRSTTRSKRKWPPEGVQELPQAPSQTTVPPGRNITDSRPLTTDRPQVLAAPSRRPRSRDSSRQVGIATLLLLLSPSNPRPPSILP

SEQ ID NO: 872621 - protein, 162 aa, Homo sapiens
VERGLVPALSRRRRRRLLSFSPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 872622 - protein, 683 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEASSPSSPERPHSRTTRRLGRSTTRSKRKWPPEGVQELPQAPSQTTVPPGRNITDSRPLTTDRPQVLAAPSRRPRSRDSSRLNESNECELLHL

SEQ ID NO: 872623 - protein, 674 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAPSSLPPALAQLPRPRPSPLPGLVCCLFICSRGD

SEQ ID NO: 872624 - protein, 716 aa, Homo sapiens
VERGLVPALSRRRRRRLLSFSLRARPGPAAPCRTTAGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAQKKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGECGPLHPIPCPLFPGPSLQATFTFCVSAGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEASSPSSPERPHSRTTRRLGRSTTRSKRKWPPEGVQELPQAPSQTTVPPGRNITDSRPLTTDWSVVFSSVQEEIETENKMRTTKKIVWQFLLFIARF

SEQ ID NO: 872625 - protein, 118 aa, Homo sapiens
MSLYFRREDFKIRASNGQFELFTGNTHTASWKGIKKPHVVDLGLYLQPPVPHVCSLQRLASRWMQVRDPLGLGLGASGRADVGSAMSCRAGSSPGASSAGQGCRAPPGRERARLGPAA

SEQ ID NO: 872626 - protein, 310 aa, Homo sapiens
FTPLRLQNSELLFLCGQLGTSIMKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTRNSTGRLALKSSSSAARPPAGVLRVARPSWTQAPLCSLCPSST

SEQ ID NO: 872627 - protein, 310 aa, Homo sapiens; identical to SEQ ID NO: 872626

SEQ ID NO: 872628 - protein, 188 aa, Homo sapiens
MEEGGRGNCTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTRNSTGRLALKSSSSAARPPAGVLRVARPSWTQAPLCSLCPSST

SEQ ID NO: 872629 - protein, 69 aa, Homo sapiens
MIPLSSMWSPSAPSSYILSNNGYCTVGVEPTYLSSQNGQPLWILGDVFLRSYYSVYDLGNNRVGFATAA

SEQ ID NO: 872630 - protein, 181 aa, Homo sapiens
FTPLRLQNSELLFLCGQLGTSIMKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSPLFLLTLHPPRALYLSFHSGFSLLFLDSGLSLIINSSSLKKEKKRHIKDNRTNIQTKNNKKRRGR

SEQ ID NO: 872631 - protein, 156 aa, Homo sapiens
EFLGDRRAVDLPGVQAAIHTPKDNRSPAGALLVAEVDAEDGAGEERTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 872632 - protein, 195 aa, Homo sapiens
FTPLRLQNSELLFLCGQLGTSIMKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTTSAW

SEQ ID NO: 872633 - protein, 102 aa, Homo sapiens
KAPFTDGIVGPEKCVGFQFQSNFTCSHPPHSQRAGWVGCRFFFLLENGPSPYASPPPWLLTPDFSLPLLWPLLFLNKAREDLGWLSPWVSVKTQRETLLKKP

SEQ ID NO: 872634 - protein, 84 aa, Homo sapiens
RQQDKEATLSASAGPLSSPLMGLSVWVAPRGQLQPQLQAPRTAGAGTLEVRVLRERGDPVLLAGVQRHHSKTSVAKYTPCSALP

SEQ ID NO: 872635 - protein, 802 aa, Homo sapiens
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 872636 - protein, 802 aa, Homo sapiens; identical to SEQ ID NO: 872635

SEQ ID NO: 872637 - protein, 718 aa, Homo sapiens
SGALRVLSWRMNLDCCSITLYFLTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 872638 - protein, 802 aa, Homo sapiens; identical to SEQ ID NO: 872635

SEQ ID NO: 872639 - protein, 802 aa, Homo sapiens; identical to SEQ ID NO: 872635

SEQ ID NO: 872640 - protein, 802 aa, Homo sapiens; identical to SEQ ID NO: 872635

SEQ ID NO: 872641 - protein, 802 aa, Homo sapiens; identical to SEQ ID NO: 872635

SEQ ID NO: 872642 - protein, 377 aa, Homo sapiens
SGALRVLSWRMNLDCCSITLYFLTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQQQLAEMWLEKNDPSYSKSSNNNGSVRTA

SEQ ID NO: 872643 - protein, 84 aa, Homo sapiens
GLGTTEEMGKLALEPGENFCMGGPGVIMSREVLRRMVPHIGKCLREMYTTHEDVEVGRCVRRFAGVQCVWSYEVRTEFFTMGKT

SEQ ID NO: 872644 - protein, 139 aa, Homo sapiens
PWLAMCTSFHAIPTVAVLPGLYKKNQFSHFMILQLNGMDMEENNLASRQAQSQTYTEAGRRCTPLRYVSHPARHMQPEPGHRLGVPCVLSSYLFSLVPTFLPEFLIHGLLPGSLPLGARGSHRAQRRGPFAPGTIRGMI

SEQ ID NO: 872645 - protein, 331 aa, Homo sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDKSQSPRSPPGKPQGPPPQGGNQPQGPPPPPGKPQGPPPQGGNKPQGPPPPGKPQGPPPQGDKSRSPQSPPGKPQGPPPQGGNQPQGPPPPPGKPQGPPPQGGNKPQGPPPPGKPQGPPAQGGSKSQSARAPPGKPQGPPQQEGNNPQGPPPPAGGNPQQPQAPPAGQPQGPPRPPQGGRPSRPPQ

SEQ ID NO: 872646 - protein, 198 aa, Homo sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPPQGGNKPQGPPPPGKPQGPPAQGGSKSQSARAPPGKPQGPPQQEGNNPQGPPPPAGGNPQQPQAPPAGQPQGPPRPPQGGRPSRPPQ

SEQ ID NO: 872647 - protein, 178 aa, Homo sapiens [sequence omitted]

SEQ ID NO: 872648 - protein, 226 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEVLLGLFYSYYVYIMNHL

SEQ ID NO: 872649 - protein, 587 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEVLLGLFYSYYVYIMNHLQKIKVTSALGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 872650 - protein, 226 aa, Homo sapiens; identical to SEQ ID NO: 872648

SEQ ID NO: 872651 - protein, 226 aa, Homo sapiens; identical to SEQ ID NO: 872648

SEQ ID NO: 872652 - protein, 561 aa, Homo sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 872653 - protein, 119 aa, Homo sapiens
MHEVHPAPTPVVSLHPPRLPPAPALPAMPPVWASGPLTLYLCWRTYRTHVFSSHGTETPFALPIRPCLQQVYTAGFLSEQSIPICTRHRTVACSLQTTYSFSLQAFAPPAQRDGAAMSI

SEQ ID NO: 872654 - protein, 103 aa, Homo sapiens
AGGAGPQLSEPRRRTRRSELSGGSAAAGAGAQEPTGPDQDGAVAAPRRTHALSGPSLGPEPPVPPAAPIRAGMMCLECASAAAGGAEEEEADAERRRRRQGGA

SEQ ID NO: 872655 - protein, 111 aa, Homo sapiens
VTRTWRMVNVGILLSNGGVSQRDGWGAGKEMDWKIIFPLESSCPSASLLSDHPQPNPSQHSDAPSLLSFSASPPCRSSTLLFFCSWSLGFIWTHDRGVVSQSDLGEGNIWA

SEQ ID NO: 872656 - protein, 146 aa, Homo sapiens
ARATLSSFLHHHPGAQRSKLLSIFSPSPRTLTLYRMGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 872657 - protein, 146 aa, Homo sapiens; identical to SEQ ID NO: 872656

SEQ ID NO: 872658 - protein, 620 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872659 - protein, 159 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETSLRDLHSAWHRTSLMTVAQERAALPTVLTPSPITWRLSWLRSLRSWRKSSPGEIPLALPSVHSIAQARNPPVQD

SEQ ID NO: 872660 - protein, 620 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872661 - protein, 620 aa, Homo sapiens; identical to SEQ ID NO: 872658

SEQ ID NO: 872662 - protein, 608 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872663 - protein, 659 aa, Homo sapiens
MWYVKLCEAESAAFRGPHFLICSLSFPHPDSLLLIQVDTMPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872664 - protein, 620 aa, Homo sapiens; identical to SEQ ID NO: 872658

SEQ ID NO: 872665 - protein, 620 aa, Homo sapiens; identical to SEQ ID NO: 872658

SEQ ID NO: 872666 - protein, 594 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872667 - protein, 615 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKVTNPSQPLAWKQLLPWMSSRPEVPSRKPRAGTLLPLKSQRQSQP

SEQ ID NO: 872668 - protein, 579 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKQESKGRKL

SEQ ID NO: 872669 - protein, 603 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGEHSDGRPVRPATQGVSNWGGYALACALYILYSCAVHSQYLRKAVGPSRAPGDQAWTQALPSVIKVTNPSQPLAWKQLLPWMSSRPEVPSRKPRAGTLLPLKSQRQSQP

SEQ ID NO: 872670 - protein, 117 aa, Homo sapiens
WRLILFCWSLTRWAVFAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872671 - protein, 620 aa, Homo sapiens; identical to SEQ ID NO: 872658

SEQ ID NO: 872672 - protein, 620 aa, Homo sapiens; identical to SEQ ID NO: 872658

SEQ ID NO: 872673 - protein, 579 aa, Homo sapiens; identical to SEQ ID NO: 872668

SEQ ID NO: 872674 - protein, 75 aa, Homo sapiens
MESCFAVLGVSNWGGYALACALYILYSCAVHSQYLRKAVGPSRAPGDQAWTQALPSVIKVTNPSQPLAWKQLLPW

SEQ ID NO: 872675 - protein, 568 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872676 - protein, 147 aa, Homo sapiens
MDEEPMEKKRRTNNGSGITPGTTYNRVRQNTTIYNTRIEKMRATEPKPGAANKPHNTKPRGSRAATTSTTERQQGEATTRDTEQSTTERSRRTKKEAVNPQEMKTHTQERETGYQRASRQEHTPERREEQHKQKEREREERQPVRAK

SEQ ID NO: 872677 - protein, 620 aa, Homo sapiens; identical to SEQ ID NO: 872658

SEQ ID NO: 872678 - protein, 620 aa, Homo sapiens; identical to SEQ ID NO: 872658

SEQ ID NO: 872679 - protein, 620 aa, Homo sapiens; identical to SEQ ID NO: 872658

SEQ ID NO: 872680 - protein, 403 aa, Homo sapiens
MVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872681 - protein, 579 aa, Homo sapiens; identical to SEQ ID NO: 872668

SEQ ID NO: 872682 - protein, 593 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGEHSDGRPVRPATQGVSNWGGYALACALYILYSCAVHSQYLRKAVGPSRAPGDQAWTQALPSVIKQESKGRKL

SEQ ID NO: 872683 - protein, 223 aa, Homo sapiens
LQKCKSVKCYNQAHILPSGKWTVGPCEKWARDPKFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 872684 - protein, 623 aa, Homo sapiens
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDKGQHFSGAF

SEQ ID NO: 872685 - protein, 620 aa, Homo sapiens; identical to SEQ ID NO: 872658

SEQ ID NO: 872686 - protein, 160 aa, Homo sapiens
RSPVRSSCLTVRSCSPPSPPSALVPAAPPLLPPSSSIFSFFSDPAGRYEGNPGDSGRPSPRSRCRGPRSRGAAAPELGRKDESLSRSGRTARSSPPPPSAGTASTAQPNRPLLHRRLLRPLRPQPARSQVTPCLTLPSKGRLCKILCYLFKLTRCPSHST

SEQ ID NO: 872687 - protein, 387 aa, Homo sapiens
PHLPPPGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQREPSWGPRQGLREEGYSWGPLGLAGTPGASSTGVARLLKPNFLQHRRKESVPWVLTHCGDAVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872688 - protein, 671 aa, Homo sapiens
MSSFLFPCNSTFFSALFSNSSRPGGGGGGGNVKSTISSAFISKLLGGGGGGGRNVSSFTDDGTIGLSSSSISYPGGGGGGGGSAKSLLLFKTRRSPFGSEAGMGLEALVPLAVIVAIFLLLVDLMHRRQRWAARYPPGPLPLPGLGNLLHVDFQNTPYCFDQVREEVLEGGRGAEDPPPEANMLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKVRVAATVGGKGGGLNVPGGMRGGWAKGWTSASPGGRIWADRCRIGGHLGATPFCPEYALGPAQAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872689 - protein, 736 aa, Homo sapiens
MSSFLFPCNSTFFSALFSNSSRPGGGGGGGNVKSTISSAFISKLLGGGGGGGRNVSSFTDDGTIGLSSSSISYPGGGGGGGGSAKSLLLFKTRRSPFGSEAGMGLEALVPLAVIVAIFLLLVDLMHRRQRWAARYPPGPLPLPGLGNLLHVDFQNTPYCFDQVREEVLEGGRGAEDPPPEANMLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKVRVAATVGGKGGGLNVPGGMRGGWAKGWTSASPGGRIWADRCRIGGHLGATPFCPEYALGPAQAKGNPESSFNDENLRIVVADLFSAGMVTTSTTLAWGLLLMILHPDVQREAQLGPKAGTEGGRVQLGAPGLSWDTRGFQHRRGQAPVSLTSSNTGGRRVSPGCCPIVGTHVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872690 - protein, 458 aa, Homo sapiens
MVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKVRVAATVGGKGGGLNVPGGMRGGWAKGGPVHHPASRIWADRCRIGGHLGATPFCPEYALGPAQAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872691 - protein, 307 aa, Homo sapiens
MLSPSSCISQRWLARSYASWDPAQPPRDLTEAFLAEMEKAKGNPESSFNDENLRIVVADLFSAGMVTTSTTLAWGLLLMILHPDVQREPSWGPRQGLREEGYSWGPLGLAGTPGASSTGVARLLKPNFLQHRRKESVPWVLTHCGEHVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872692 - protein, 243 aa, Homo sapiens
MLSPSSCISQRWLARSYASWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872693 - protein, 485 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872694 - protein, 608 aa, Homo sapiens
MSSFLFPCNSTFFSALFSNSSRPGGGGGGGNVKSTISSAFISKLLGGGGGGGRNVSSFTDDGTIGLSSSSISYPGGGGGGGGSAKSLLLFKTRRSPFGSEAGMGLEALVPLAVIVAIFLLLVDLMHRRQRWAARYPPGPLPLPGLGNLLHVDFQNTPYCFDQVREEVLEGGRGAEDPPPEANMLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872695 - protein, 430 aa, Homo sapiens
MSSFLFPCNSTFFSALFSNSSRPGGGGGGGNVKSTISSAFISKLLGGGGGGGRNVSSFTDDGTIGLSSSSISYPGGGGGGGGSAKSLLLFKTRRSPFGSEAGMGLEALVPLAVIVAIFLLLVDLMHRRQRWAARYPPGPLPLPGLGNLLHVDFQNTPYCFDQVREEVLEGGRGAEDPPPEANMLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVAVSNRRSTT

SEQ ID NO: 872696 - protein, 139 aa, Homo sapiens
MGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHSWCLQLSW

SEQ ID NO: 872697 - protein, 105 aa, Homo sapiens
CRPRRDEAAARWVAPISRGGPFWAPGGGGRESGRSRGRGALFVSWCSLRRASASRDSPAAPCLCPVRLVHPPRRGSSPGMGMRTSPRWTPVKQRKGELIGLRSRQ

SEQ ID NO: 872698 - protein, 605 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 872699 - protein, 637 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYKKGLADMSSQVGGSEEQVLRTRGVAHPPSFGFSQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 872700 - protein, 516 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLRILKIHQGWDMTFKGD

SEQ ID NO: 872701 - protein, 204 aa, Homo sapiens
YTIYNGTTDRSEFTCLRACLALSLFCMFLLGKPFGPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 872702 - protein, 199 aa, Homo sapiens
RPRSPLSPSLLLSTFVGLLLNKAKNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGGKRMKGKMPVFTVACSCLSGA

SEQ ID NO: 872703 - protein, 605 aa, Homo sapiens; identical to SEQ ID NO: 872698

SEQ ID NO: 872704 - protein, 371 aa, Homo sapiens
RPRSPLSPSLLLSTFVGLLLNKAKNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 872705 - protein, 433 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGGKRMKGKMPVFTVACSCLSGA

SEQ ID NO: 872706 - protein, 107 aa, Homo sapiens
PTPRTAYTENGWQSLRPRSRCPWGGSLKGRPAGLGGTERSRRGVSRSCPLRADSPLSPQRHSHVLQPSAHQRRLPALLRTGQPALPNVAPGATSLLPSPWWPRSLNF

SEQ ID NO: 872707 - protein, 143 aa, Homo sapiens
YYLDFSYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSP

SEQ ID NO: 872708 - protein, 186 aa, Homo sapiens
MSTNNALRVFWKSREWNMKTSTFDSDEDILLLPKRKRFRKKKSRPVRHTKRHEEEQVYEQGTTLPCSICKHEIDLTGIFLHKKQHVALATLGFQWMGRKKPQPSVIAVQRQFMISKLLSSFMFTEKTLQSINNAFELLWKKQIPAYYKIFDNIDRSVIYSQKICHLLIKGVGICEDRNSTWKADMN

SEQ ID NO: 872709 - protein, 416 aa, Homo sapiens
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 872710 - protein, 397 aa, Homo sapiens
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPGEVRLADSAASRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 872711 - protein, 333 aa, Homo sapiens
MENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 872712 - protein, 71 aa, Homo sapiens
FPSVSSESEQSQAVQGLGHRGRYVGLAAPSDQGGGLGGTPHTHLLTLGTHTLPLAAQSWARRSHSRYVPSK

SEQ ID NO: 872713 - protein, 477 aa, Homo sapiens
AGTGLGCLGSRGCLLSVADGAGREGGPGPALPGLGRCCWRLALHQASLWQESELCRGRRLRMMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 872714 - protein, 303 aa, Homo sapiens
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPGSLDCCTEVPRPLRWQLLLRPQRP

SEQ ID NO: 872715 - protein, 97 aa, Homo sapiens
SLDCCTEVPRPLRWQLLLVKGVRRGPPNTLILGGRRGLPHGTDGATEALKRKCVSPNSKCGQQKEEAGPSMEKPHSSRTSRGQCPQKGGGVYVSPCS

SEQ ID NO: 872716 - protein, 766 aa, Homo sapiens [sequence omitted]

SEQ ID NO: 872717 - protein, 110 aa, Homo sapiens
IITSDPIQTFCFAAIGIFLMQQLVNLLKGVLQIDSSSAYLICAPRGQRKGKRPWRILTETCKQKQLFQSVTSLFMKETFRKLQLGPGQKEELPKRETFSYLCWAHLHVPG

SEQ ID NO: 872718 - protein, 137 aa, Homo sapiens
LVIVNTKAKKGIGREPLKNPKAFSAAAAAALLLLSVSPLVLGAGEPWALHGPAGGGKDTTALALLGRPLQPHRKTCEELHKTAMQNGAGGALFVHRDTPENNPDTPFDFTPENYKRIEAIVKNYPEGHKAAAVLPVL

SEQ ID NO: 872719 - protein, 148 aa, Homo sapiens
GDLEDPYDVGRGLWSGCFGKMAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 872720 - protein, 128 aa, Homo sapiens
MAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 872721 - protein, 128 aa, Homo sapiens; identical to SEQ ID NO: 872720

SEQ ID NO: 872722 - protein, 128 aa, Homo sapiens; identical to SEQ ID NO: 872720

SEQ ID NO: 872723 - protein, 138 aa, Homo sapiens
GDLEDPYDVGRGLWSGCFGKMAGSGVRQATSTASTFVKPIFSRDMNEAKRRVRELYRAWYREVPNTKMGRDKVREMFMKNAHVTDPRVVDLLVIKGKIELEETIKVWKQRTHVMRFFHETEAPRPKDFLSKFYVGHDP

SEQ ID NO: 872724 - protein, 128 aa, Homo sapiens; identical to SEQ ID NO: 872720

SEQ ID NO: 872725 - protein, 81 aa, Homo sapiens
KLRLGTRLGGKMAGSGVRQATSTASTFVKPIFSRDMNEAKRRVRELYRAWYREVPNTGRLVNVVVSIAPMIRHFSVRAQII

SEQ ID NO: 872726 - protein, 155 aa, Homo sapiens
TPRYRIPGPSYAARDARRGLWSGCFGKMAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 872727 - protein, 139 aa, Homo sapiens
KLRLGTRLGGKMAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 872728 - protein, 139 aa, Homo sapiens; identical to SEQ ID NO: 872727

SEQ ID NO: 872729 - protein, 128 aa, Homo sapiens; identical to SEQ ID NO: 872720

SEQ ID NO: 872730 - protein, 130 aa, Homo sapiens
GDLEDPYDVGRGLWSGCFGKMAGSGVRQATSTASTFVKPIFSRDMNEAKRRVRELYRAWYREVPNTVHQFQLDITVDPRVVDLLVIKGKIELEETIKVWKQRTHVMRFFHETEAPRPKDFLSKFYVGHDP

SEQ ID NO: 872731 - protein, 128 aa, Homo sapiens; identical to SEQ ID NO: 872720

SEQ ID NO: 872732 - protein, 101 aa, Homo sapiens
KLRLGTRLGGKMAGSGVRQATSTASTFVKPIFSRDMNEAKRRVRELYRAWYREVPNTKMGRDKVREMFMKNAHVTDPRVVDLLVIKGKIELEETIKVWKQR

SEQ ID NO: 872733 - protein, 365 aa, Homo sapiens
IQNPACQLVFQKAKKNRDVHPGALVPASSLKGGNLGSMSVRSKLPNSPAASSHPKLKSSKGITKKPQAPSNNASSSLASLNPVGKNTSSPALPRTAPCISESPRKCISSPNTPKAKVIPAQNSADLPESTLLPNKCSGKTQPKYLKHNHISSRDNAVSHLAAHSNSSSKCPKLPKANIPVRPKPSFQSSAKMTKTSSKTIATGLGTQSQPSDGAPQAKPVPAQKLKSALNLNQPVSVSSVSPVKATQKSKDKNIVSATKKQPQNKSAFQKTGPSSLKSPGRTPLSIVSLPQSSTKTQTAPKSAQTVAKSQHSTKGPPRSGKTPASIRKPPSSVKDADSGDKKPTAKKKEDDDHYFVMTGSKKPRK

SEQ ID NO: 872734 - protein, 164 aa, Homo sapiens [sequence omitted]

SEQ ID NO: 872735 - protein, 97 aa, Homo sapiens
TDSPLCHVDIAIPCNNKGAHSVGLMWMLAREVLRVRGTISREHPWEVMPELYFYRDPEVIKKEEQAATEKAVTKEEFQCEWTAPAPEFTATQPEVAH

SEQ ID NO: 872736 - protein, 71 aa, Homo sapiens
YIMHLPAWLTRFLVFPVCLVRLDSLHNSPPTFPGEISCSLLKVPLSYLTYMATFPGNHEICNGRVYALFIG

SEQ ID NO: 872737 - protein, 108 aa, Homo sapiens
CSIWNLVMPFARVRQSWNKERAWKGRAGKGSDRRVLTKEKKKKMLMVRVERRGLVDPGHWVRPWPGCFGQMMDLNLKTSREADTQAPGSEPPKQSRVCQMARNPHRCR

SEQ ID NO: 872738 - protein, 148 aa, Homo sapiens
TRQRPQKEPGAASEPGAWAGVPESTAAAGHWEGQKTGNGKPGTHGVTQRRDYSAGSPAFALCVSSGDFETRFLSGPPRAASPWPASSALESPSTGGTGRRSPRRGTSSVVKAVRTLGARQGFGPLLNPTTVLSGAGRFEDLDSLMLTA

SEQ ID NO: 872739 - protein, 42 aa, Homo sapiens
MGLTRSDGVKNGSFSAQALCLLPFTKDVTCFSLPSAMIVRPP

SEQ ID NO: 872740 - protein, 112 aa, Homo sapiens
MLVGSPSHGIVGGAENDMEGALGSLSAPHHKVRRSRHYHHHQGGKKHIQIRPSQESQDFRAQSASLFVLEIKEESPVTGSHEPVRQAPSLLRELGLTADTWGKEARGPRATQ

SEQ ID NO: 872741 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 872742 - protein, 370 aa, Homo sapiens; identical to SEQ ID NO: 872741

SEQ ID NO: 872743 - protein, 370 aa, Homo sapiens; identical to SEQ ID NO: 872741

SEQ ID NO: 872744 - protein, 333 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVCHS

SEQ ID NO: 872745 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 872746 - protein, 106 aa, Homo sapiens
MLYSSIYTVSLLGTTSTYLTHTVRSSLLCLEMIDTIVVHYSYLSLIHFKQPTPYLHTHELVPIAILNLLTGSVIKARRVKSPTLLIYFSNCVASYQYPTLSLISYL

SEQ ID NO: 872747 - protein, 246 aa, Homo sapiens
MVVDFWTWEQTFQELIQEAKPRATWTLKLDGNLQLDCLAQGWKQYQQRAFGWFRCSSCQRSWASAKLQILCHTYWEHWTSQGQVRMRLFGQRCQKCSWSQYEMPEFSSDSTMRILSNLVQHILKKYYGNGMRKSPEMPVILEVSLEGSHDTANCEACTLGICGQGLKSYMTKPSKSLLPHLKTGNSSPGIGAVYLANQAKNQSDEAKEAKGSGYEKLGPSRDPDPLNICVFILLLVFIVVKCFTSE

SEQ ID NO: 872748 - protein, 246 aa, Homo sapiens; identical to SEQ ID NO: 872747

SEQ ID NO: 872749 - protein, 148 aa, Homo sapiens
MAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRD

SEQ ID NO: 872750 - protein, 736 aa, Homo sapiens
MNVALQELGAGSNVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 872751 - protein, 256 aa, Homo sapiens
MNVALQELGAGSNVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVRNIFRTPIPTPG

SEQ ID NO: 872752 - protein, 765 aa, Homo sapiens
MNVALQELGAGSNMVEYKRATLRDEDAPETPVEGGASPDAMEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 872753 - protein, 485 aa, Homo sapiens
MEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 872754 - protein, 150 aa, Homo sapiens
MSGWIATSKTRMQDFWSLLTFSSDLVDVKDSGDYPLTAPGLSWKKFQGSFCEFVGTLVCRCQYILLHDDFPMDNLISLLTGFSDSQVCAFCHTSTLAAMKLMTSLVRVALQLSLHEDINQRQYEAERNKGPGQRAPERLESLLEKHKELH

SEQ ID NO: 872755 - protein, 141 aa, Homo sapiens
MFKKMSNSEIIQHLTEQFNEDSGDYPLTAPGLSWKKFQGSFCEFVGTLVCRCQYILLHDDFPMDNLISLLTGFSDSQVCAFCHTSTLAAMKLMTSLVRVALQLSLHEDINQRQYEAERNKGPGQRAPERLESLLEKHKELH

SEQ ID NO: 872756 - protein, 150 aa, Homo sapiens; identical to SEQ ID NO: 872754

SEQ ID NO: 872757 - protein, 150 aa, Homo sapiens; identical to SEQ ID NO: 872754

SEQ ID NO: 872758 - protein, 310 aa, Homo sapiens
MGNQVEKLTHLSYKEVPTADPTGVDRDDGPRIGVSYIFSNDDEDVEPQPPPQGPDGGGLPDGGDGPPPPQPQPYDPRLHEVECSVFYRDECIYQKSFAPGSAALSTYTPENLLNKCKPGDLVEFVSQAQYPHWAVYVGNFQVVHLHRLEVINSFLTDASQGRRGRVVNDLYRYKPLSSSAVVRNALAHVGAKERELSWRNSESFAAWCRYGKREFKIGGELRIGKQPYRLQIQLSAQRSHTLEFQSLEDLIMEKRRNDQIGRAAVLQELATHLHPAEPEEGDSNVARTTPPPGRPPAPSSEEEDGEAVAH

SEQ ID NO: 872759 - protein, 310 aa, Homo sapiens; identical to SEQ ID NO: 872758

SEQ ID NO: 872760 - protein, 310 aa, Homo sapiens; identical to SEQ ID NO: 872758

SEQ ID NO: 872761 - protein, 78 aa, Homo sapiens
RGVSACLFKCHGLRSRPGARSRIYNPVPPAPVLVARPAQAGAVAARLRGCRPLLLAPHLPRELAEEGQQPQLAGGSAV

SEQ ID NO: 872762 - protein, 310 aa, Homo sapiens; identical to SEQ ID NO: 872758

SEQ ID NO: 872763 - protein, 105 aa, Homo sapiens
GLPDGGDGPPPPQPQPYDPRLHEVECSVFYRDECIYQKSFAPGSAALSTYTPENLLNKCKPGDLVEFVSQAQYPHWAVYVGNFQVVHLHRLEVINSFLTDASQGR

SEQ ID NO: 872764 - protein, 310 aa, Homo sapiens; identical to SEQ ID NO: 872758

SEQ ID NO: 872765 - protein, 292 aa, Homo sapiens
MGNQVEKLTHLSYKEVPTADPTGVDRDDGPRIGVSYIFSNDDEDVEPQPPPQPQPYDPRLHEVECSVFYRDECIYQKSFAPGSAALSTYTPENLLNKCKPGDLVEFVSQAQYPHWAVYVGNFQVVHLHRLEVINSFLTDASQGRRGRVVNDLYRYKPLSSSAVVRNALAHVGAKERELSWRNSESFAAWCRYGKREFKIGGELRIGKQPYRLQIQLSAQRSHTLEFQSLEDLIMEKRRNDQIGRAAVLQELATHLHPAEPEEGDSNVARTTPPPGRPPAPSSEEEDGEAVAH

SEQ ID NO: 872766 - protein, 102 aa, Homo sapiens
YNILSSTRNHGKLSEACADSVSPVKRLADSVNYCVWNTSRIKRHAGTDERIASRCLRINPKWTFHGRVDYDMRLMIRYNRRYRVDSMSQGKNYEIGDCPALG

SEQ ID NO: 872767 - protein, 310 aa, Homo sapiens; identical to SEQ ID NO: 872758

SEQ ID NO: 872768 - protein, 778 aa, Homo sapiens
MDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 872769 - protein, 795 aa, Homo sapiens
MCCVWYVCTEVSLISHSRVVIESDVDEIFGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 872770 - protein, 397 aa, Homo sapiens
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQRIPLTYI

SEQ ID NO: 872771 - protein, 785 aa, Homo sapiens
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 872772 - protein, 798 aa, Homo sapiens
SEGPARANRLPGPPSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 872773 - protein, 732 aa, Homo sapiens
MESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 872774 - protein, 498 aa, Homo sapiens
RVQGAQELGWLSPAHPAMRWLWPLAVSLAVILAVGLSRVSGGAPLHLGRHRAETQEQQSRSKRGTEDEEAKGVQQYVPEEWAEYPRPIHPAGLQPTKPLVATSPNPDKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 872775 - protein, 252 aa, Homo sapiens
GGSSRPAASLEPSSWAPCTHLLFLGWLSPAHPAMRWLWPLAVSLAVILAVGLSRVSGGAPLHLGRHRAETQEQQSRSKRGTEDEEAKGVQQYVPEEWAEYPRPIHPAGLQPTKPLVATSPNPDKDGGTPDSGQELRGNLTGAPGQRLQIQNPLYPVTESSYSAYAIMLLALVVFAVGIVGNLSVMCIVWHSYYLKSAWNSILASPSTLFSGPDLSQSWMPPPTGAFFSSRGFLSPSSSFLWDPWVALSQPPC

SEQ ID NO: 872776 - protein, 511 aa, Homo sapiens
LVLARNRWDSSWAPCTHLLFLGWLSPAHPAMRWLWPLAVSLAVILAVGLSRVSGGAPLHLGRHRAETQEQQSRSKRGTEDEEAKGVQQYVPEEWAEYPRPIHPAGLQPTKPLVATSPNPDKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 872777 - protein, 258 aa, Homo sapiens
ASVSRAEGPPPPAPSMLRRGYKASERRRHLSERLSWHQDQALSSSIYLLREMGPTGFLLREEEPEYMDFRVFLGNPHVCNCSTFPKGGELCKHICWVLLKKFKLPRNHESALQLGLGEREISDLLRGIHRVQTPQPGTNDENEHVEEDGYIKQKEIDSEDICSICQELLLEKKLPVTFCRFGCGNSIHIKCMKILANYQSTSNTSMLKCPLCRKEFAPLKLILEEFKNSSKLVAAAENRETGQTPRGFSVITCKQFPN

SEQ ID NO: 872778 - protein, 201 aa, Homo sapiens
MSRRIIVGTLQRTQRNMNSGISQVFQRELTCPICMNYFIDPVTIDCGHSFCRPCFYLNWQDIPILTQCFECIKTIQQRNLKTNIRLKKMASLARKASLWLFLSSEEQMCGIHRETKKMFCEVDRSLLCLLCSSSQEHRYHRHCPAEWAAEEHWEKLLKKMQSLWEKACENQRNLNVETTRISHWKALETYYTLLETYYTEE

SEQ ID NO: 872779 - protein, 204 aa, Homo sapiens
MSRRIIVGTLQRTQRNMNSGISQVFQRELTCPICMNYFIDPVTIDCGHSFCRPCFYLNWQDIPILTQCFECIKTIQQRNLKTNIRLKKMASLARKASLWLFLSSEEQMCGIHRETKKMFCEVDRSLLCLLCSSSQEHRYHRHCPAEWAAEEHWEKLLKKMQSLWEKACENQRNLNVETTRISHWKALETYYTGVSPCCCTCPSL

SEQ ID NO: 872780 - protein, 121 aa, Homo sapiens [sequence omitted]

SEQ ID NO: 872781 - protein, 107 aa, Homo sapiens
MLTPGAAQHGSSTIWGLCRFWRLCSGLGSVPCVFSMGEHWTRGSATPLLGCGLECIHFGPICPSTATAELRIPGVGKCSSVIGRARQCGTGYVVMRSTPPSPLNLIF

SEQ ID NO: 872782 - protein, 76 aa, Homo sapiens
GWVVRQVLWKESWALRREVQAWAWLDPLCDPRQATLPLRFSASTYQTGTQASSLLMVAIMRRVIHILLSPAFLQTR

SEQ ID NO: 872783 - protein, 183 aa, Homo sapiens
MRKSLHSSLGDRARLCLKKERNTLAAHSEGPEICVLLQQCLDGTDPGTLFLPASDHLGISSPLAISGTIFLAIFCFWDQPTPFLWLAPSCQPTMSSQIHQNYSTEGEATINRLVNLHLRASYICLCLGFYSHRDNVSLEGMGHFGELAEEKRQGTERFLKMQSQHGSCALFHDIQMPAQDEYG

SEQ ID NO: 872784 - protein, 731 aa, Homo sapiens
GGSSPCLRCNSCASSGAPAAGAGDNLSLLLRTSSPGGAFRTRTSSPLSGSSCCCCCCSSRRGSQLNVSELTPSSHASALRQQYAQQSAQQSASASQYHQCHSLQPAASPTGSLGSLGSAPPLSHHHHHPHPAHHQHHQPQARRESNPFTEIAMSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 872785 - protein, 231 aa, Homo sapiens
MWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 872786 - protein, 591 aa, Homo sapiens
GGSSPCLRCNSCASSGAPAAGAGDNLSLLLRTSSPGGAFRTRTSSPLSGSSCCCCCCSSRRGSQLNVSELTPSSHASALRQQYAQQSAQQSASASQYHQCHSLQPAASPTGSLGSLGSAPPLSHHHHHPHPAHHQHHQPQARRESNPFTEIAMSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHARKYRYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 872787 - protein, 107 aa, Homo sapiens [sequence omitted]

SEQ ID NO: 872788 - protein, 346 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 872789 - protein, 375 aa, Homo sapiens
MALDVKSRAKRYEKLDFLGEGQFATVYKARDKNTNQIVAIKKESLLVATTAVNVLCHTRSQYVSEFHLRPMIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 872790 - protein, 253 aa, Homo sapiens
METDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 872791 - protein, 312 aa, Homo sapiens
MRSWTSLGRDSLPPFTRPEIRIPTKLSPLRKSNLDIDQKLKMLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 872792 - protein, 158 aa, Homo sapiens [sequence omitted]

SEQ ID NO: 872793 - protein, 197 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARNLSGSAGTE

SEQ ID NO: 872794 - protein, 137 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRI

SEQ ID NO: 872795 - protein, 346 aa, Homo sapiens; identical to SEQ ID NO: 872788

SEQ ID NO: 872796 - protein, 346 aa, Homo sapiens; identical to SEQ ID NO: 872788

SEQ ID NO: 872797 - protein, 253 aa, Homo sapiens; identical to SEQ ID NO: 872790

SEQ ID NO: 872798 - protein, 229 aa, Homo sapiens
MLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 872799 - protein, 307 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRSFWPEIELSVQILTWAPLGTWRHGVFRFVNLSSGTWAPSGGRSTQGVLIGRYARRRDFCRAVVVASRLAHRGKKSAASARGVPVRSVSALLFSFAFGV

SEQ ID NO: 872800 - protein, 103 aa, Homo sapiens
HLFIHLSFIHPPIIPSIPHSSIQPPTNPASTYPFIHSSVYPPTMYPSNLIQGATACGTMLSNVKTTINSSIIVPVPNGLPSTAVCTQGCGGNPGPQIRRNDPS

SEQ ID NO: 872801 - protein, 271 aa, Homo sapiens
SGGRRALRPPRRAAAVPAPAPQPEPAPCPGEVQRAGSEAGPGRAVSGVCKSRVSGMRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 872802 - protein, 271 aa, Homo sapiens; identical to SEQ ID NO: 872801

SEQ ID NO: 872803 - protein, 272 aa, Homo sapiens
SGGRRALRPPRRAAAVPAPAPQPEPAPCPGEVQRAGSEAGPGRAVSGVCKSRVSGMRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTSLPSNSPPELGAPDCPEDGGSGLRGTGPLLRVATAAPATAVTSPSSAPGQCPSLACLLPLC

SEQ ID NO: 872804 - protein, 150 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFRCAHLAF

SEQ ID NO: 872805 - protein, 134 aa, Homo sapiens
RAEFGTSGTMLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQDLDDMS

SEQ ID NO: 872806 - protein, 406 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 872807 - protein, 406 aa, Homo sapiens; identical to SEQ ID NO: 872806

SEQ ID NO: 872808 - protein, 356 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVR

SEQ ID NO: 872809 - protein, 299 aa, Homo sapiens
MLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 872810 - protein, 407 aa, Homo sapiens
DPPGCRFLGRYLGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 872811 - protein, 185 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLIVITSKEKKMNCYLNLSRKRHFWN

SEQ ID NO: 872812 - protein, 406 aa, Homo sapiens; identical to SEQ ID NO: 872806

SEQ ID NO: 872813 - protein, 406 aa, Homo sapiens; identical to SEQ ID NO: 872806

SEQ ID NO: 872814 - protein, 388 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 872815 - protein, 406 aa, Homo sapiens; identical to SEQ ID NO: 872806

SEQ ID NO: 872816 - protein, 299 aa, Homo sapiens; identical to SEQ ID NO: 872809

SEQ ID NO: 872817 - protein, 381 aa, Homo sapiens
MWPLIFLEKTQTYLSYFIKIRSDPTKEVTLKVTLKSLHNILNALNMIKIVNTTYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 872818 - protein, 359 aa, Homo sapiens
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAAR

SEQ ID NO: 872819 - protein, 423 aa, Homo sapiens
EPFFFPFSQKRLNINYIANMSKVFKKTSSNGKVREPGPAGQMRGQKGELSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAASSEDIVIEEFTRKGEEESQKAVEAEGDEGS

SEQ ID NO: 872820 - protein, 388 aa, Homo sapiens
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAASSEDIVIEEFTRKGEEESQKAVEAEGDEGS

SEQ ID NO: 872821 - protein, 213 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872822 - protein, 111 aa, Homo sapiens
PVQHREVQGNESDLFMSYFPRGLKYQEGGVESAFHKTSTVAQENQGVFFSGDSYLVLHNGPEEVSHLHLWIALQVAEGFISRMQYAPNTQVEILPQGRESPIFKQFFKDWK

SEQ ID NO: 872823 - protein, 213 aa, Homo sapiens; identical to SEQ ID NO: 872821

SEQ ID NO: 872824 - protein, 213 aa, Homo sapiens; identical to SEQ ID NO: 872821

SEQ ID NO: 872825 - protein, 213 aa, Homo sapiens; identical to SEQ ID NO: 872821

SEQ ID NO: 872826 - protein, 213 aa, Homo sapiens; identical to SEQ ID NO: 872821

SEQ ID NO: 872827 - protein, 213 aa, Homo sapiens; identical to SEQ ID NO: 872821

SEQ ID NO: 872828 - protein, 213 aa, Homo sapiens; identical to SEQ ID NO: 872821

SEQ ID NO: 872829 - protein, 213 aa, Homo sapiens; identical to SEQ ID NO: 872821

SEQ ID NO: 872830 - protein, 213 aa, Homo sapiens; identical to SEQ ID NO: 872821

SEQ ID NO: 872831 - protein, 367 aa, Homo sapiens
SLLVSDSEMPSLICLGCDLQRAEATVVGLCGPPASLCAPLRRRPGIPTAHPSDCSSASGLLAPSTACPSLSGDIAFPNNPPWAGKRARPPMWGVWGVLLGRGGESFGYGLGRQCHDETVHRTGTRVEREKRAPGGWGGKGWKEDEPTKQRSEDSMYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872832 - protein, 393 aa, Homo sapiens
SLLVSDSEMPSLICLGCDLQRAEATVVGLCGPPASLCAPLRRRPGIPTAHPSDCSSASGLLAPSTACPSLSGDIASTPAGEGAQEVGLVGGAGGWGSQRSKREVRSRVGQAGRKTNLRSRDLKTACTQPFPRGEAACPISFHNFPFFTSKGCPSPLLSSSPDCSRQACPGLCLGKWVQAAVNPLSSRSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872833 - protein, 291 aa, Homo sapiens
MPHLLSQLPLLYLQGLPLPTALLIPRLQSPGLPRAVLGQVGPGCCQPSLFSQWLSIPRLSAGSRPACVAGGEAEAGACGAREPGRLLLGGLLPSAAQWPRRGFPSAPVDRVRGSGWGKVGPRKGREGAGMDHKGLALPSPTVPGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872834 - protein, 213 aa, Homo sapiens; identical to SEQ ID NO: 872821

SEQ ID NO: 872835 - protein, 130 aa, Homo sapiens
MIQVLGPQACSEGRATLRKTSQLNKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 872836 - protein, 130 aa, Homo sapiens; identical to SEQ ID NO: 872835

SEQ ID NO: 872837 - protein, 205 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQGPRWRFVTDGRGSLLR

SEQ ID NO: 872838 - protein, 182 aa, Homo sapiens
SLLVSDSEMPSLICLGCDLQRAEATVVGLCGPPASLCAPLRRRPGIPTAHPSDCSSASGLLAPSTACPSLSGDIAFPNNPPWAGKRARPPMWGVWGVLLGRGGESFGYGLGRQCHDETVHRTGTRVEREKRAPGGWGGKAGRKTNLRSRDLKTACTQPFPRVALHSQAQCRIQACMCGGWRS

SEQ ID NO: 872839 - protein, 159 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLASLAAWSVQRCPLQMFNKGDKCFPSSFPAALFLHHLPWADSHCHPPIHLGSSPCWGWSSTQMTIGQPWRGQSCFA

SEQ ID NO: 872840 - protein, 226 aa, Homo sapiens
RKESRSVERSEDSMYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872841 - protein, 228 aa, Homo sapiens
LVPVPSRMDQRSEDSMYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872842 - protein, 240 aa, Homo sapiens
LVEAGVISDESGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQVSELRQRRRLCAGTFTHCHQTTLPCRPAPDCCILDELYARRDTRDRPTQSAATRLRAPEPGSTRFNTVLDCIHPWTLGQNIFAWCGGKSNILGTQQRRGDLALAIRDSERQGKAQVEIGH

SEQ ID NO: 872843 - protein, 213 aa, Homo sapiens; identical to SEQ ID NO: 872821

SEQ ID NO: 872844 - protein, 213 aa, Homo sapiens; identical to SEQ ID NO: 872821

SEQ ID NO: 872845 - protein, 247 aa, Homo sapiens
LTGGGSWPRTSRGRGAAETAPRASEQGVGRSEDSMYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872846 - protein, 213 aa, Homo sapiens; identical to SEQ ID NO: 872821

SEQ ID NO: 872847 - protein, 226 aa, Homo sapiens; identical to SEQ ID NO: 872840

SEQ ID NO: 872848 - protein, 213 aa, Homo sapiens; identical to SEQ ID NO: 872821

SEQ ID NO: 872849 - protein, 130 aa, Homo sapiens; identical to SEQ ID NO: 872835

SEQ ID NO: 872850 - protein, 213 aa, Homo sapiens; identical to SEQ ID NO: 872821

SEQ ID NO: 872851 - protein, 383 aa, Homo sapiens
SLLVSDSEMPSLICLGCDLQRAEATVVGLCGPPASLCAPLRRRPGIPTAHPSDCSSASGLLAPSTACPSLSGDIAFPNNPPWAGKRARPPMWGVWGVLLGRGGESFGYGLGRQCHDETVHRTGTRVEREKRAPGGWGGKGWKEDEPTKQRSEDSMYTAIPQSGSPFPGSVQDPGLHVWRVEKLKPVPVAQENQGVFFSGDSYLVLHNGPEEVSHLHLWIGEGDLDGGRLGPGRGGRGLVWITRALPCPLPLVPGQQSSRDEQGACAVLAVHQSDLFMSYFPRGLKYQEGGVESAFHKTSTGAPAAIKKLYQVKGKKNIRATERALNWDSFNTGDCFILDLGQNIFAWCGGKSNILGTQQRRGDLALAIRDSERQGKAQVEIGH

SEQ ID NO: 872852 - protein, 130 aa, Homo sapiens; identical to SEQ ID NO: 872835

SEQ ID NO: 872853 - protein, 143 aa, Homo sapiens
RIFGSLYWGSSCLDIQVLGPQACSEGRATLRKTSQLNKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 872854 - protein, 182 aa, Homo sapiens; identical to SEQ ID NO: 872838

SEQ ID NO: 872855 - protein, 41 aa, Homo sapiens
MTLSEILDYRSVAEAPGPVWTFPSQEGLGSIPFVPVTLSIP

SEQ ID NO: 872856 - protein, 495 aa, Homo sapiens
MRAAAGTRRARLGRRRLLRSAAGVAAAAAPSSSFQREEEAEGGEAHRVRGGDRGGAPRAASLIAMDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 872857 - protein, 526 aa, Homo sapiens
MRAAAGTRRARLGRRRLLRSAAGVAAAAAPSSSFQREEEAEGGEAHRGDCLCTTSFKVIIVRITGGHFECFRKVIETQLFSTTVSYLLPFLELIAMDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 872858 - protein, 348 aa, Homo sapiens
MRAAAGTRRARLGRRRLLRSAAGVAAAAAPSSSFQREEEAEGGEAHRVRGGDRGGAPRAASLIAMDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPISSIPPLQEPATT

SEQ ID NO: 872859 - protein, 378 aa, Homo sapiens
MNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 872860 - protein, 162 aa, Homo sapiens
GSRYKPRYGEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLICQAGVQWCIQLTTASNSWARVILPPLPL

SEQ ID NO: 872861 - protein, 469 aa, Homo sapiens
MRAAAGTRRARLGRRRLLRSAAGVAAAAAPSSSFQREEEAEGGEAHRVRGGDRGGAPRAASLIAMDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQVACSLFMVSPLLSFICPFKQIQNLYTQVCFLLLRFVLERLCVTVM

SEQ ID NO: 872862 - protein, 74 aa, Homo sapiens
MPSILQGVPDRRSRAHRGTAAVNKRSCFHYTTKQTTPEGGAGSNCPKVSRFTSLPQLSRCVWARGSPLIAWVPF

SEQ ID NO: 872863 - protein, 152 aa, Homo sapiens
GGGGRGALVGAPRSARASCLRGRRPGRRQPCGRCPDPPRSGPGQAGRARCARDVAAQTALAPRALALGAGAAGPGWRGAVPRRPAARVSRAAQRQEQVSARPLAGPKPPTPPRPPVEPQSCPAKDDERQPGASLGLPRAAPSAGDRALRSRR

SEQ ID NO: 872864 - protein, 1106 aa, Homo sapiens
PEGAAAEHWLERREAPEPLAFAGGALAAGSLVAGAPIRRAPDPGRRGAPAARGMWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872865 - protein, 1043 aa, Homo sapiens
PCGRPGGRERACRKVGGGVARHLGRDQRNESLEMLNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872866 - protein, 723 aa, Homo sapiens
LPSTSLPSQLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872867 - protein, 475 aa, Homo sapiens
DSRVIPTLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872868 - protein, 334 aa, Homo sapiens
PEGAAAEHWLERREAPEPLAFAGGALAAGSLVAGAPIRRAPDPGRRGAPAARGMWQPRRPWPRVPWRWALALLALVGAGLCHAGPQPGYPARPSARNKNWCAYIVNKNVSAARARPAEAQRPRNRRGPWATARPAPAAPRGEAAPAARLHRGHRGDGPGRAPRRRRRHPGQSIPSFSAPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872869 - protein, 1071 aa, Homo sapiens
QARALQRRTRAPSGVCSVKLPPPQRATGPPDPRSVWCRSPLSPGLIVLRVYPVPLSLSLLHPRNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872870 - protein, 762 aa, Homo sapiens
MSVWVLIPPAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872871 - protein, 451 aa, Homo sapiens
ELPPLEVPSAGDVGAVAAALVEPEPSSRPPRSPGAPRQGPSAARGRGRGAPAGVWFRDGAGVGGLRSLSVTCDAPAVSACCEIEELLDAGAKSEAGLESAAVCAGEAGNAPAPGRGPRRRPGGPLRPRKMRADARVSRWPDVAGVAAESSRGPRSPGLMEGTLTGQSGLRFPNPVCFFLPDALAEAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 872872 - protein, 1106 aa, Homo sapiens; identical to SEQ ID NO: 872864

SEQ ID NO: 872873 - protein, 329 aa, Homo sapiens
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 872874 - protein, 275 aa, Homo sapiens
MPSRSPFTWSHLCWRAGRCPRWRACLSSSSVRMCSPAAPSRFGALGISARRWPRRDADTWCAPQVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 872875 - protein, 329 aa, Homo sapiens; identical to SEQ ID NO: 872873

SEQ ID NO: 872876 - protein, 267 aa, Homo sapiens
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLGE

SEQ ID NO: 872877 - protein, 329 aa, Homo sapiens; identical to SEQ ID NO: 872873

SEQ ID NO: 872878 - protein, 329 aa, Homo sapiens; identical to SEQ ID NO: 872873

SEQ ID NO: 872879 - protein, 79 aa, Homo sapiens
VLLPFPSSLHPPILADDERMLVEPACGAALAAIYSGLLRRLQAEGCLPPSLTSVVVIVCGGNNINSRELQALKTHLGQV

SEQ ID NO: 872880 - protein, 156 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 872881 - protein, 156 aa, Homo sapiens; identical to SEQ ID NO: 872880

SEQ ID NO: 872882 - protein, 125 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLVFGIILVSIFAYDAFKIYRTEMAPGASQGDQQ

SEQ ID NO: 872883 - protein, 102 aa, Homo sapiens
CIFLSSPSFFPFPHHSWALSHAMPCTQRCALTHTDFTAAGPRAIRRTTSARSTLPLSKGPAPALAWLDPPGLAYSSRCPLGSSPSAWLLVLVALVHLLPLPG

SEQ ID NO: 872884 - protein, 129 aa, Homo sapiens
MLSARDRRDRHPEEGVVAELQGFAVDKAFLTSHKGILLETELVTAASQPGASISLTPGSWPALCQPPAHPSVASFPKPSGHLSCPQLPLLRLLLCLLAASPPGDIYSRFQLQQEGLQLDRVTFWDIEEA

SEQ ID NO: 872885 - protein, 129 aa, Homo sapiens; identical to SEQ ID NO: 872884

SEQ ID NO: 872886 - protein, 241 aa, Homo sapiens
MMDLFETGSYFFYLDGENVTLQPLEVAEGSPLYPGSDGTLSPCQDQMPPEAGSDSSGEEHVLAPPGLQPPHCPGQCLIWACKTCKRKSAPTDRRKAATLRERRRLKKINEAFEALKRRTVANPNQRLPKVEILRSAISYIERLQDLLHRLDQQEKMQELGVDPFSYRPKQENLEGADFLRTCSSQWPSVSDHSRGLVITAKEGGASIDSSASSSLRCLSSIVDSISSEERKLPCVEEVVEK

SEQ ID NO: 872887 - protein, 125 aa, Homo sapiens
APTAPDGPSLDESGSSSEAELETLNDEPPVLLGAGSGPHEGPRLGAAVLLPRLSLETRLQQEGDPGLRGSLRELWEPEDEDEAVLERDLELSLRPGLEAPPFPGAKGRSLGDGLEDMEDLARLRL

SEQ ID NO: 872888 - protein, 195 aa, Homo sapiens
MGFFNYLTYFLAAGAVTLGIGFFALASALWFLICKRREIFQNSKFKAIDERCRQRPSMAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 872889 - protein, 48 aa, Homo sapiens
MRTGAELCLTTKNPLGHKGGGAEHVLGTQLYSHYKDYSSRCHGGSCLR

SEQ ID NO: 872890 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 872891 - protein, 799 aa, Homo sapiens
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 872892 - protein, 780 aa, Homo sapiens
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKSLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 872893 - protein, 687 aa, Homo sapiens
MVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 872894 - protein, 349 aa, Homo sapiens
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEE

SEQ ID NO: 872895 - protein, 113 aa, Homo sapiens
AGAAAASSKIELSWLLQLLTSSCISQPALPLLSSHHAISPRLLPLTWTGARWDITQSTTLVSQRVGEVTVFHSKPHLVLGTFHFQLFTGLLLWGQNSDFQENALHCKRIFQIT

SEQ ID NO: 872896 - protein, 176 aa, Homo sapiens
RGRRGPDTVTRRRGAGSSGRAWPCCPSAFRRRRRASGPSGLQGGRRVDGEPAPGGQIPSRDGAPGPRELRRDARAPVSHPVASPLRAALRAGWRDAVPHRRGKTAPPRPGRWNFPPAPPARRCPLAGERCRGPGEAAGPDLPAGLALPRRLRGSAAGSPSVPHSTPHTKNDDFIKM

SEQ ID NO: 872897 - protein, 198 aa, Homo sapiens
SSHSGPLSLDYSEPVSVCTPPLFSRSRSAFSSPRFSRLLGFGCVGGPSSPVAQTYQTRLGHRPASKSPPASHASPEPTVLPSVPPSPSGALLGARSIPCSCFTLSFSPRRDSLATSSTAVQLPQSGTHCYTQPHEPLQTSQVSSRALPDPAHIPSAGLCWSQKATAPAFHSARVQLQPPPPFLPFPVLGHVVATLCDF

SEQ ID NO: 872898 - protein, 198 aa, Homo sapiens; identical to SEQ ID NO: 872897

SEQ ID NO: 872899 - protein, 198 aa, Homo sapiens; identical to SEQ ID NO: 872897

SEQ ID NO: 872900 - protein, 133 aa, Homo sapiens
SSHSGPLSLDYSEPVSVCTPPLFSRSRSAFSSPRFSRLLGFGCVGGPSSPVAQTYQTRLGHRPASKSPPASHASPEPTVLPSVPPSPSGALLGARSIPCSCFTLSFSPRRDSLATSSTAVQLPQSGTHLEGAS

SEQ ID NO: 872901 - protein, 133 aa, Homo sapiens; identical to SEQ ID NO: 872900

SEQ ID NO: 872902 - protein, 198 aa, Homo sapiens; identical to SEQ ID NO: 872897

SEQ ID NO: 872903 - protein, 188 aa, Homo sapiens
SSHSGPLSLDYSEPVSVCTPPLFSRSRSAFSSPRFSRLLGFGCVGGPSSPVAQTYQTRLGHRPASKSPPASHASPEPTVLPSVPPSPSGALLGARSIPCSCFTLSFSPRRDSLATSSTAVQLPQSGTHCYTQPHEPLQTSQSRRSFLTGTRECMSVHLVAAGWGREQGPLTLCAGRDLPPAPQPASSP

SEQ ID NO: 872904 - protein, 188 aa, Homo sapiens; identical to SEQ ID NO: 872903

SEQ ID NO: 872905 - protein, 151 aa, Homo sapiens
MGEKAGIQAGVHTTEGEISILRGICKDLVTVKACLCTKKKKKKKEEGREREGKREGKREREKERKPARRKLSFFPINQLSGAQVAKLQGKWNSLCSLKGALGEVSVISQVVPSSRPRAPGLTLCRVGAESCSTSRQGPQGSNHAAPQQGEK

SEQ ID NO: 872906 - protein, 109 aa, Homo sapiens
SKSRSPHKGVKRGGSKRNYHVDQPQIKESWHEEEQEPISSQGSQERWQQKKIPQSQLPLPLVSPQRALPWCASHSTKQQQEQQKGNCQGDLMLDQSQRGAYGMWIKCQL

SEQ ID NO: 872907 - protein, 74 aa, Homo sapiens
ARADLLTRESREVAAKEITMSTSRKLKSHGMRRSKSRSPHKGVKRGGSKRKYRKGNLKSRKRGDDANRNYRSHL

SEQ ID NO: 872908 - protein, 128 aa, Homo sapiens
LTAKRFLDVVVTDKKLHFPECSEGSDRATQVMKGGTASWDPQFRLSTRQILRVAGRSYWGVVVETGFHHVGHAGLELQNSSDPSASVFQTAGITGVSHRAQPLGKFFLPSIIHCHHTFCLRVIYNKFN

SEQ ID NO: 872909 - protein, 336 aa, Homo sapiens
LIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRYSYLSPLQIQQIPIPKLAAPNCLLVTWVTNRQKHLRFIKEELYPSWSVEVVAEWHWVKITNSGEFVFPLDSPHKKPYEGLILGRVQEKTALPLRNADVNVLPIPDHKLIVSVPCTLHSHKPPLAEVLKDYIKPDGEYLELFARNLQPGWTSWGNEVLKFQHVDYFIALESGSWTMILIKVVVSSLSPHHFSLNSKSFYYF

SEQ ID NO: 872910 - protein, 164 aa, Homo sapiens
LIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRWSLTPLPGRDCATAVRSPAWATERDSVS

SEQ ID NO: 872911 - protein, 146 aa, Homo sapiens
SASVGRRRPWRRHVPCGGGREIAWTSGRPRTAMAFTLYSLLQAALLCVNAIAVLHEERFLKNIGWGTDQGIGGFGEEPGIKSQLMNLIRSVRTVMRVPLIIVNSIAMCVTFIIWMNISGENGDSEEDMPVEVITCGHYWNIYILAG

SEQ ID NO: 872912 - protein, 146 aa, Homo sapiens; identical to SEQ ID NO: 872911

SEQ ID NO: 872913 - protein, 146 aa, Homo sapiens; identical to SEQ ID NO: 872911

SEQ ID NO: 872914 - protein, 141 aa, Homo sapiens
GTHQLAPTVPCGGGREIAWTSGRPRTAMAFTLYSLLQAALLCVNAIAVLHEERFLKNIGWGTDQGIGGFGEEPGIKSQLMNLIRSVRTVMRVPLIIVNSIAMCVTFIIWMNISGENGDSEEDMPVEVITCGHYWNIYILAG

SEQ ID NO: 872915 - protein, 146 aa, Homo sapiens; identical to SEQ ID NO: 872911

SEQ ID NO: 872916 - protein, 146 aa, Homo sapiens; identical to SEQ ID NO: 872911

SEQ ID NO: 872917 - protein, 146 aa, Homo sapiens; identical to SEQ ID NO: 872911

SEQ ID NO: 872918 - protein, 146 aa, Homo sapiens; identical to SEQ ID NO: 872911

SEQ ID NO: 872919 - protein, 114 aa, Homo sapiens
MAFTLYSLLQAALLCVNAIAVLHEERFLKNIGWGTDQGIGGFGEEPGIKSQLMNLIRSVRTVMRVPLIIVNSIAMCVTFIIWMNISGENGDSEEDMPVEVITCGHYWNIYILAG

SEQ ID NO: 872920 - protein, 146 aa, Homo sapiens; identical to SEQ ID NO: 872911

SEQ ID NO: 872921 - protein, 146 aa, Homo sapiens; identical to SEQ ID NO: 872911

SEQ ID NO: 872922 - protein, 146 aa, Homo sapiens; identical to SEQ ID NO: 872911

SEQ ID NO: 872923 - protein, 146 aa, Homo sapiens; identical to SEQ ID NO: 872911

SEQ ID NO: 872924 - protein, 437 aa, Homo sapiens
IPAARMEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 872925 - protein, 437 aa, Homo sapiens; identical to SEQ ID NO: 872924

SEQ ID NO: 872926 - protein, 437 aa, Homo sapiens; identical to SEQ ID NO: 872924

SEQ ID NO: 872927 - protein, 419 aa, Homo sapiens
IPAARMEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFEYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 872928 - protein, 437 aa, Homo sapiens; identical to SEQ ID NO: 872924

SEQ ID NO: 872929 - protein, 154 aa, Homo sapiens
MGPQKDTVGRHGQLLEELQGECTTGPQKDTAGKHGQPLGVLGGCGGNQQKTVGGSGQKGGAFLGSAVGPSCQPHIPPTPKARRDNRGGGGPLPENKGAQWSKATYADTGALLKSQAPALSSPCHCLHQAQLTHGLAPCTEGSTARGPDTLEAAL

SEQ ID NO: 872930 - protein, 402 aa, Homo sapiens
AAAHMMRKTSCLQYLDARNTPLLDHSAPFVARALRIRSSLAVLHLENASLSGRPLMLLATALKMNMNLRELYLADNKLNGLQDSAQLGNLLKFNCSLQILDLRNNHVLDSGLAYICEGLKEQRKGLVTLVLWNNQLTHTGMAFLGMTLPHTQSLETLNLGHNPIGNEGVRHLKNGLISNRSVLRLGLASTKLTCEGAVAVAEFIAESPRLLRLDLRENEIKTGGLMALSLALKVNHSLLRLDLDREPKKEAVKSFIETQKALLAEIQNGCKRNLVLAREREEKEQPPQLSASMPETTATEPQPDDEPAAGVQNGAPSPAPSPDSDSDSDSDGEEEEEEEGERDETPCPALVPPTDSLGPGDRSPPGSPLHTHRSSGFPCPSPGRGHKVFVVTRVESPPERAE

SEQ ID NO: 872931 - protein, 432 aa, Homo sapiens
AAAHMMRKTSCLQYLDARNTPLLDHSAPFVARALRIRSSLAVLHLENASLSGRPLMLLATALKMNMNLRELYLADNKLNGLQDSAQLGNLLKFNCSLQILDLRNNHVLDSGLAYICEGLKEQRKGLVTLVLWNNQLTHTGMAFLGMTLPHTQSLETLNLGHNPIGNEGVRHLKNGLISNRSVLRLGLASTKLTCEGAVAVAEFIAESPRLLRLDLRENEIKTGGLMALSLALKVNHSLLRLDLDREPKKEAVSRGRSCSPGAGGRPGGGAGLRALARRSRQQVKSFIETQKALLAEIQNGCKRNLVLAREREEKEQPPQLSASMPETTATEPQPDDEPAAGVQNGAPSPAPSPDSDSDSDSDGEEEEEEEGERDETPCPALVPPTDSLGPGDRSPPGSPSTPTEQRISVSSPGRGHKVFVVTRVESPPERAE

SEQ ID NO: 872932 - protein, 296 aa, Homo sapiens
PVIISGRAGPARQPREPANPVALLRGRVIGRTTKQKSLINSGRRGRRWRSRSKQGFGGITCTHSPAATGGGAQRVRRRDPPPGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 872933 - protein, 208 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 872934 - protein, 208 aa, Homo sapiens; identical to SEQ ID NO: 872933

SEQ ID NO: 872935 - protein, 102 aa, Homo sapiens
PVIISGRAGPARQPREPANPVASPPRSRHRPNNQTEKFNKQRTEGPAVAEPEQAGVRRHYLYPFTGGYRRRRAACQAERPAARNESEVCCSKTQKALKCFLA

SEQ ID NO: 872936 - protein, 296 aa, Homo sapiens; identical to SEQ ID NO: 872932

SEQ ID NO: 872937 - protein, 208 aa, Homo sapiens; identical to SEQ ID NO: 872933

SEQ ID NO: 872938 - protein, 208 aa, Homo sapiens; identical to SEQ ID NO: 872933

SEQ ID NO: 872939 - protein, 208 aa, Homo sapiens; identical to SEQ ID NO: 872933

SEQ ID NO: 872940 - protein, 208 aa, Homo sapiens; identical to SEQ ID NO: 872933

SEQ ID NO: 872941 - protein, 208 aa, Homo sapiens; identical to SEQ ID NO: 872933

SEQ ID NO: 872942 - protein, 223 aa, Homo sapiens
MLLLPNRDKGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 872943 - protein, 208 aa, Homo sapiens; identical to SEQ ID NO: 872933

SEQ ID NO: 872944 - protein, 180 aa, Homo sapiens [sequence omitted]

SEQ ID NO: 872945 - protein, 124 aa, Homo sapiens
MQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 872946 - protein, 296 aa, Homo sapiens; identical to SEQ ID NO: 872932

SEQ ID NO: 872947 - protein, 133 aa, Homo sapiens
LLLKSFGSMLSEIPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 872948 - protein, 172 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTVFDAAVEEIRDSK

SEQ ID NO: 872949 - protein, 102 aa, Homo sapiens; identical to SEQ ID NO: 872935

SEQ ID NO: 872950 - protein, 208 aa, Homo sapiens; identical to SEQ ID NO: 872933

SEQ ID NO: 872951 - protein, 206 aa, Homo sapiens
PVIISGRAGPARQPREPANPVASPPRSRHRPNNQTEKFNKQRTEGPAVAEPEQAGVRRHYLYPFTGGYRRRRAACQAERPAARSKDTDLAAYQKGNLGVQLRNMAQETNHSQVPMLCSTGCGFYGNPRTNGMCSVCYKEHLQRQNSSNGRISPPGSMHRWQCARSPVSIRLYIFIYAAQPCIKSVTFIRICSIFSIGQYICGQSST

SEQ ID NO: 872952 - protein, 172 aa, Homo sapiens; identical to SEQ ID NO: 872948

SEQ ID NO: 872953 - protein, 208 aa, Homo sapiens; identical to SEQ ID NO: 872933

SEQ ID NO: 872954 - protein, 208 aa, Homo sapiens; identical to SEQ ID NO: 872933

SEQ ID NO: 872955 - protein, 208 aa, Homo sapiens; identical to SEQ ID NO: 872933

SEQ ID NO: 872956 - protein, 208 aa, Homo sapiens; identical to SEQ ID NO: 872933

SEQ ID NO: 872957 - protein, 296 aa, Homo sapiens; identical to SEQ ID NO: 872932

SEQ ID NO: 872958 - protein, 124 aa, Homo sapiens; identical to SEQ ID NO: 872945

SEQ ID NO: 872959 - protein, 296 aa, Homo sapiens; identical to SEQ ID NO: 872932

SEQ ID NO: 872960 - protein, 296 aa, Homo sapiens; identical to SEQ ID NO: 872932

SEQ ID NO: 872961 - protein, 102 aa, Homo sapiens; identical to SEQ ID NO: 872935

SEQ ID NO: 872962 - protein, 102 aa, Homo sapiens; identical to SEQ ID NO: 872935

SEQ ID NO: 872963 - protein, 3530 aa, Homo sapiens [sequence omitted]

SEQ ID NO: 872964 - protein, 1846 aa, Homo sapiens
MSFTEGEAKTQVHKFLDKNHDQVRQDVLDLFVRSRTRSPGPCLSVFPAPTPAQVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLARGMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQGLELCRVVAVHVENLLSAHEKRLTLPPSEITLL

SEQ ID NO: 872965 - protein, 1805 aa, Homo sapiens
MSFTEGEAKTQVHKFLDKNHDQVRQDVLDLFVRSRTRSPGPCLSVFPAPTPAQVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLARGMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHVSGLSLALPSPPSVPWSPTPSKRPRPPAAEAQFHCLPPS

SEQ ID NO: 872966 - protein, 571 aa, Homo sapiens
RERERERERERESVSARKLASKPERQTERGTRRETQREKKQPEAELCQGSTSNLFQFIHPSLLSAQTVELGLSKFVPKKMIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 872967 - protein, 301 aa, Homo sapiens
RERERERERERESVSARKLASKPERQTERGTRRETQREKKQPEAELCQGSTSNLFQFIHPSLLSAQTVELGLSKFVPKKMIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRIEEVQKHRSMMKPSVSYTVAPWIQEGGPGGRHRLKMEK

SEQ ID NO: 872968 - protein, 472 aa, Homo sapiens
RERERERERERESVSARKLASKPERQTERGTRRETQREKKQPEAELCQGSTSNLFQFIHPSLLSAQTVELGLSKFVPKKMIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKVMPHTFGTLSLT

SEQ ID NO: 872969 - protein, 60 aa, Homo sapiens
MEPASCCAERPKPGPTGVKTKPSCGGWRAVGLLLLLLLLVLAAVGVVAGGLLGSAQGPPK

SEQ ID NO: 872970 - protein, 538 aa, Homo sapiens
TRDPHPIGTGAGGEGSARGSSCRATWGIGMVLWILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLDPYKIFTHDSFEKAELSVLEQLNVSPQISKYNLELTYEHFKSEEILRAVLPEGQDVTSGFSRIGHIAHLNLRDHQLPFKHLIGQVMIDKNPGITSAVNKINNIDNMYRNFQMEVLSGEQNMMTKVRENNYTYEFDFSKVYWNPRLSTEHSRITELLKPGDVLFDVFAGVGPFAIPVAKKNCTVFANDLNPESHKWLLYNCKLNKVDQKVKVFNLDGKDFLQGPVKEELMQLLGLSKERKPSVHVVMNLPAKAIEFLSAFKWLLDGQPCSSEFLPIVHCYSFSKDANPAEDVRQRAGAVLGISLEACSSVHLVRNVAPNKEMLCITFQIPASVLYKNQTRNPENHEDPPLKRQRTAEAFSDEKTQIVSNT

SEQ ID NO: 872971 - protein, 538 aa, Homo sapiens; identical to SEQ ID NO: 872970

SEQ ID NO: 872972 - protein, 115 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTRRRRARLVRRFSLPVPAGVTTVSPLT

SEQ ID NO: 872973 - protein, 110 aa, Homo sapiens
QFLHPSFLQPPLPTTPTPVPREPGRKPLSSSRLGEVTGSPSPPPRSGAPTPSSRAPALSPTRVSSFLPYLSSCPAEVQVQPLLAQSLATPTPPGPARTHPGPRIFSSTGP

SEQ ID NO: 872974 - protein, 691 aa, Homo sapiens
MNTGVILSHQTQPKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872975 - protein, 626 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872976 - protein, 573 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872977 - protein, 1438 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRVSSFLPYLSSCPAEVQVQPLLAQSLADSHSPGSRSHPSRPQNLLIHRPLRAPQCPVPLPPARLSSHPSRTLPHPRLTTCLHPSELSAELRAPMLGLLATNEGRDDEVTRPKELFGDWVEPIPNIRRASQTQSRCRREWSIVHASSVVDQLKQELPTTYANQKRWTQETARDPLPWSSPSHPHATRFTLLPPFSPAEVRGVRVDACLRVNARVSFSCHTAFPSLCSVCLFLPFSFTSAQTDRINPDDIDLENEPWYKFFSELEFGRPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872978 - protein, 626 aa, Homo sapiens; identical to SEQ ID NO: 872975

SEQ ID NO: 872979 - protein, 697 aa, Homo sapiens
MREREKDFGFLLLQGLYLHHEGPPLMTYLNLITSPTWGQRSAVTDGTTLTTAAATHSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872980 - protein, 545 aa, Homo sapiens
MKATTPLQTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872981 - protein, 691 aa, Homo sapiens; identical to SEQ ID NO: 872974

SEQ ID NO: 872982 - protein, 131 aa, Homo sapiens [sequence omitted]

SEQ ID NO: 872983 - protein, 235 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPVTKPQAS

SEQ ID NO: 872984 - protein, 233 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPVSTCH

SEQ ID NO: 872985 - protein, 333 aa, Homo sapiens [sequence omitted]

SEQ ID NO: 872986 - protein, 152 aa, Homo sapiens
MKATTPLQTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPVSTCH

SEQ ID NO: 872987 - protein, 189 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGRMGFLARNDYFMLSNVWKNDTVTFFPLLFEHMFSVHILGGGFLFFSQSVHNKRIDFSHGNEN

SEQ ID NO: 872988 - protein, 66 aa, Homo sapiens
VSGGRRQLLRAWAGSSWLTKSTGREGLCQPGEGSRGQDESNNTFAGEVGGHAGRDCSCIYFAARPM

SEQ ID NO: 872989 - protein, 75 aa, Homo sapiens
MQHGTSLDSTDTYPQHAQSLDGTTSSSIPLYRSSEEEKRVTVIKAPHYPGIGPVDESGIPTAIRTTVDPAKDWVQ

SEQ ID NO: 872990 - protein, 691 aa, Homo sapiens; identical to SEQ ID NO: 872974

SEQ ID NO: 872991 - protein, 911 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRVSSFLPYLSSCPAEVQVQPLLAQSLADSHSPGSRSHPSRPQNLLIHRPLRAPQCPVPLPPARLSSHPSRTLPHPRLTTCLHPSELSAELRAPMLGLLATNEGRDDEVTRPKELFGDWVEPIPNIRRASQTQSRCRREWSIVHASSVVDQLKQELPTTYANQKRWTQETARDPLPWSSPSHPHATRFTLLPPFSPAEVRGVRVDACLRVNARVSFSCHTAFPSLCSVCLFLPFSFTSAQTDRINPDDIDLENEPWYKFFSELEFGRPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872992 - protein, 626 aa, Homo sapiens; identical to SEQ ID NO: 872975

SEQ ID NO: 872993 - protein, 691 aa, Homo sapiens; identical to SEQ ID NO: 872974

SEQ ID NO: 872994 - protein, 477 aa, Homo sapiens
MKATTPLQTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 872995 - protein, 583 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPRGPPVVMPYGFQCAVTISTCHQTTSRVAAAAVSLGTTWQAGPPP

SEQ ID NO: 872996 - protein, 514 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKVAQLVFCLFVFVCLFFSGFEKAVYFQN

SEQ ID NO: 872997 - protein, 329 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRVSSFLPYLSSCPAEVQVQPLLAQSLATPTPPGPARTHPGPRIFSSTGP

SEQ ID NO: 872998 - protein, 154 aa, Homo sapiens
MKATTPLQTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPVTKPQAS

SEQ ID NO: 872999 - protein, 67 aa, Homo sapiens
VMIGLYNPPYSAQSHPAAKTQTYRPLSKSHSDNSPNAFKDASSPVPPPHVPPPVPPLRPRDRSSTEK

SEQ ID NO: 873000 - protein, 1499 aa, Homo sapiens
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYLTCLMTPVAALLPRLFFRSLQGRVFPTQLQLARQLTRKSPRRCSAPKETFAQGRLPKDSGTEHSSGRTVKTSVPLSQPSWHTQQPVCSLEASGEPSTVDMSMPVREHTLLEGLSAPAPMSSAPGEAVLRSPGGCPEESKVRAASTGRVTPLSSLFSLPTFSLLNWISSWSLVSRLGSVLQFSRTEQLADGQAGRGLPVQPHSGRSGLQGPDHRLLIGASSRRSQ

SEQ ID NO: 873001 - protein, 1499 aa, Homo sapiens; identical to SEQ ID NO: 873000

SEQ ID NO: 873002 - protein, 1385 aa, Homo sapiens
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYLTCLMTPVAALLPRLFFRSLQGRVFPTQLQLARQLTRKSPRRCSAPKETFAQGRLPKDSGTEHSSGRTVKTSVPLSQPSWHTHPAGGAERTGPHVLCARGGCPEESRRVS

SEQ ID NO: 873003 - protein, 1306 aa, Homo sapiens
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYYDLQMDKRDVDFLSSPTQADQDFKGQTTDYL

SEQ ID NO: 873004 - protein, 1499 aa, Homo sapiens; identical to SEQ ID NO: 873000

SEQ ID NO: 873005 - protein, 1499 aa, Homo sapiens; identical to SEQ ID NO: 873000

SEQ ID NO: 873006 - protein, 1250 aa, Homo sapiens
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWVRAACMATSQKSTDAVDPTLPADS

SEQ ID NO: 873007 - protein, 134 aa, Homo sapiens
MPADLSGTWTLLSSDNFEGYMLALGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 873008 - protein, 130 aa, Homo sapiens
WACIQGLFLGETVTEKALWGGELWAECPCSRAGGGSCFLPQGCSSSVGSSQGRAQGLPLSPQVREGFGGDKWSWVGVPWGSGAQVDGACLLLGEIDPHTHTHTHTHFVAHMHSCLLDKNSSITGHLLFGH

SEQ ID NO: 873009 - protein, 662 aa, Homo sapiens
SRRGRAAPSPRPDRSPAGEGLRRRRRRRPWWQWWRRSSLPGSCLELEERVVPGELCTGAAASPPVPPPQSPRSRRIRRRRRRQDMELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSAVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 873010 - protein, 630 aa, Homo sapiens
SRRGRAAPSPRPDRSPAGEGLRRRRRRRPWWQWWRRSSLPGSCLELEERVVPGELCTGAAASPPVPPPQSPRSRRIRRRRRRQDMELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSAVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 873011 - protein, 584 aa, Homo sapiens
SRRGRAAPSPRPDRSPAGEGLRRRRRRRPWWQWWRRSSLPGSCLELEERVVPGELCTGAAASPPVPPPQSPRSRRIRRRRRRQDMELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSAVKGIYLDTADEDFYARFATGCVSIPWQNEGCLTMVPSEKEVEPKQC

SEQ ID NO: 873012 - protein, 616 aa, Homo sapiens
SRRGRAAPSPRPDRSPAGEGLRRRRRRRPWWQWWRRSSLPGSCLELEERVVPGELCTGAAASPPVPPPQSPRSRRIRRRRRRQDMELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSAVKGIYLDTADEDFYARFATGCVSIPWQNEGCLTMVPSEKEVEPKQC

SEQ ID NO: 873013 - protein, 128 aa, Homo sapiens
AGGKSRGKVSPFFHSGAGVMTGEGPGRSEVMMVIMGVTAESGRVGARNRRSVSVRRQCSEADTQVTSLESPCSEMGNVAPFSEAPTLKGASCFKLLVLSSRFLQASLQSLVSKAIRPVRSRATCPVSP

SEQ ID NO: 873014 - protein, 43 aa, Homo sapiens
LGCVVLRMSHLEGRSKYMKIGFSGVQSNLFTLGLWQAPIPFMD

SEQ ID NO: 873015 - protein, 118 aa, Homo sapiens
MKLITILFLCSRLLLSLTQESQSEEIDCNDKDLFKAVDAALKKYNSQNQSNNQFVLYRITEATKTVRLALTRFIPSSTKSRRGIVLFKVAKPGRTVSTRMLQKHSKCIGHSWAFCFLR

SEQ ID NO: 873016 - protein, 467 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873017 - protein, 467 aa, Homo sapiens; identical to SEQ ID NO: 873016

SEQ ID NO: 873018 - protein, 467 aa, Homo sapiens; identical to SEQ ID NO: 873016

SEQ ID NO: 873019 - protein, 437 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKK

SEQ ID NO: 873020 - protein, 449 aa, Homo sapiens
MLNESIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873021 - protein, 199 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMV

SEQ ID NO: 873022 - protein, 631 aa, Homo sapiens
MKLITILFLCSRLLLSLTQESQSEEIDCNDKDLFKAVDAALKKYNSQNQSNNQFVLYRITEATKTVRLALTRFIPSSTKSRRGIVLFKVAKPGRTVSTRMLQKQKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873023 - protein, 266 aa, Homo sapiens [sequence omitted]

SEQ ID NO: 873024 - protein, 250 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 873025 - protein, 449 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873026 - protein, 467 aa, Homo sapiens; identical to SEQ ID NO: 873016

SEQ ID NO: 873027 - protein, 451 aa, Homo sapiens
MLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGCPGRPWKSVSEINPTTQMKESYYFDLTDGLS

SEQ ID NO: 873028 - protein, 626 aa, Homo sapiens
MKLITILFLCSRLLLSLTQESQSEEIDCNDKDLFKAVDAALKKYNSPVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873029 - protein, 621 aa, Homo sapiens
MKLITILFLCSRLLLSLTQESQSEEIDCNDKDLFKAVDAALKKYNSQNQSNNQFVLYRITEATKTVRLALTRFIPSSTKSRRGIVLFKVAKPGRTVSTRMLQKQPLENARQPWGRGAVRNSPWLPRPARLLQLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873030 - protein, 642 aa, Homo sapiens
MKLITILFLCSRLLLSLTQESQSEEIDCNDKDLFKAVDAALKKYNSQNQSNNQFVLYRITEATKTVRLALTRFIPSSTKSRRGIVLFKVAKPGRTVSTRMLQKHPRERHKTREKEPYPNPPAIQSCHILQTRAFVTNPNQWVCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873031 - protein, 102 aa, Homo sapiens
MKLITIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 873032 - protein, 623 aa, Homo sapiens
MEHAVAPCVLYPGTEPGAAGESESEGAASPAQTPCSLGASLCFSSGEESPPQSLASAAEGAATSPPSSGGPRVVERQWEAGSAGAASPEELASPEERACPEEPAAPSPEPRVWLEDPASPEEPGEPAPVPPGFGAVYGEPDLVLEVSGRRLRAHKAVLAARSDYFRARASRDVLRVQGVSLTALRLLLADAYSGRMAGVRPDNVAEVVAGARRLQLPGAAQRATDAVGPQLSLANCYEVLSAAKRQRLNELRDAAYCFMSDHYLEVLREPAVFGRLSGAERDLLLRRRLRAGRAHLLAAALGPAGERAGSRPQSPSGDADARGDAAVYCFHAAAGEWRELTRLPEGAPARGCGLCVLYNYLFVAGGVAPAGPDGRARPSDQVFCYNPATDSWSAVRPLRQARSQLRLLALDGHLYAVGGECLLSVERYDPRADRWAPVAPLPRGAFAVAHEATTCHGEIYVSGGSLFYRLLKYDPRRDEWQECPCSSSRERSADMVALDGFIYRFDLSGSRGEAQAAGPSGVSVSRYHCLAKQWSPCVAPLRLPGGPTGLQPFRCAALDGAIYCVSRAGTWRFQPAREGEAGGDAGQGGGFEALGAPLDVRGVLIPFALSLPEKPPRGEQGAP

SEQ ID NO: 873033 - protein, 623 aa, Homo sapiens; identical to SEQ ID NO: 873032

SEQ ID NO: 873034 - protein, 623 aa, Homo sapiens; identical to SEQ ID NO: 873032

SEQ ID NO: 873035 - protein, 115 aa, Homo sapiens
RRACSRQHGASLSSTAMNPGIHVRGSHCRTWKSGKRKANCLETKPECRRKSRVEGCLLPPTQQKQGIWPFPSPRLAMEASLGGLIPVLDPSGVPPIVTGEPRPATRWISWELCQK

SEQ ID NO: 873036 - protein, 133 aa, Homo sapiens
RARRCGPSPVGFSSASLSLPPCRGLAVLRVPVDLWNSGISSQSPLTFIILLYELGMMGAVMPLEQMGKPRLGSQSWWDTEPVTDIEEQWGRITVPSGAFSLSKAVSITTNRKSQGSETPGQCGVIHAHPSLWP

SEQ ID NO: 873037 - protein, 130 aa, Homo sapiens
MLASFSGSPSLVVAKRLPKPLGRYPTLSEIPTEKEGPRSMSDWTNLGHVPIPKPRTIARGMEFYFEWPSPATSLDLRDGTSSSEGIWTENVFPRKMVHCFQNKGDLMLNRQRQICPLQGWELHLSHAGNV

SEQ ID NO: 873038 - protein, 70 aa, Homo sapiens
NHVMLAKTAEDMGKKFYIVWTKLDMDLSTGALPEVQLLQIRENVLENLQKERSSRNQQVYPNHSHVPLAC

SEQ ID NO: 873039 - protein, 158 aa, Homo sapiens
RPRVSLQRGCGLNSGRRRNSGAALGREYKAGWWPLCGTAPAARLPGGPHPCVPETLLLKNALSNATVRPRATRARLEGSLFPFSNCSGHLNGLSLPESRPQPRCPHLAWAGPKLVSRFKSAPAISLPALPGRLGGGPPNGFLSSFQRLHISLNYLKYL

SEQ ID NO: 873040 - protein, 102 aa, Homo sapiens
SALVCWLRSLCPAGRVALSLLSPPVPSEPPFPSHSLVHQYTPATQALALFFRNLSSFACWFPYCYPLILRDFYSLIPPCSRCLRRRGRQIVCPVSIYNLSLF

SEQ ID NO: 873041 - protein, 122 aa, Homo sapiens
PESFRFPAKSFDVDSGPSQCCRALLRELLPLLLAPDPASLGWRRRKRKRGYCLHGPARKPHPGPGAFCLPVTRSRCYLLSPVLWVLPSTGPSIALLFHLADSSTFFTFLFFFLRRSLSCCPG

SEQ ID NO: 873042 - protein, 113 aa, Homo sapiens
MGKARRKPVPGPLGSLLLRAEAVHTRNPASPGLPRGSTPGGRAAAWARSRLCRKQIMTHFSGSPGPGPRAVASAKLSGPGHQLPASQPEATAAQHPAPFKVAPKRRKPNRSGW

SEQ ID NO: 873043 - protein, 113 aa, Homo sapiens; identical to SEQ ID NO: 873042

SEQ ID NO: 873044 - protein, 108 aa, Homo sapiens
VCTECRHTLPSLYQNVRLPAGEQVFCIKHIVCINSSGIVSHCYQKPRFLEATQESTLQEGLSKHKHLCLPCLTLLHSRGPTQNSQNNLGKKNKFGRLILPDFRTSTKV

SEQ ID NO: 873045 - protein, 340 aa, Homo sapiens
MSGEPELIELRELAPAGRAGKGRTRLERANALRIARGTACNPTRQLVPGRGHRFQPAGPATHTWCDLCGDFIWGVVRKGLQCAHCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 873046 - protein, 189 aa, Homo sapiens
MSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 873047 - protein, 152 aa, Homo sapiens
MSGEPELIELRELAPAGRAGKGRTRLERANALRIARGTACNPTRQLVPGRGHRFQPAGPATHTWCDLCGDFIWGVVRKGLQCAQQGRFLHRLHQGSAEAGAPCLCALQQEATLLAGCPAGPRTGHKCQAPHFLLPAQGCCQAPACAVTHKGT

SEQ ID NO: 873048 - protein, 189 aa, Homo sapiens; identical to SEQ ID NO: 873046

SEQ ID NO: 873049 - protein, 263 aa, Homo sapiens [sequence omitted]

SEQ ID NO: 873050 - protein, 145 aa, Homo sapiens [sequence omitted]

SEQ ID NO: 873051 - protein, 270 aa, Homo sapiens
MGEAEAPSFEMTWSSTTSSGYCSQEDSDSELEQYFTARTSLARRPRRDQDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 873052 - protein, 189 aa, Homo sapiens; identical to SEQ ID NO: 873046

SEQ ID NO: 873053 - protein, 270 aa, Homo sapiens; identical to SEQ ID NO: 873051

SEQ ID NO: 873054 - protein, 189 aa, Homo sapiens; identical to SEQ ID NO: 873046

SEQ ID NO: 873055 - protein, 191 aa, Homo sapiens
LLAGCPAGGFLLEGTETGQHQLQLNLDEACVRTASLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 873056 - protein, 140 aa, Homo sapiens [sequence omitted]

SEQ ID NO: 873057 - protein, 122 aa, Homo sapiens
NGTKRRILYVVLRREQSPALLDVVLGNLLETMSLLHSESSGGFPVPLTWNQTPRLAMQSGPGILAPSPVHCGWLCWPRGSQALHPHAPLSTCTCVPPPALTSCPPALICDASVRPLLPACPL

SEQ ID NO: 873058 - protein, 118 aa, Homo sapiens [sequence omitted]

SEQ ID NO: 873059 - protein, 487 aa, Homo sapiens
TVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 873060 - protein, 149 aa, Homo sapiens
RERVIPLSSQLEASLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873061 - protein, 78 aa, Homo sapiens
MAEEEETSVKKKKKRGKKKHIKEEPLSEEEPCTSTAIASPEKKNEQNANDNERARRKSPCKELPIVSPRIHAREGTEL

SEQ ID NO: 873062 - protein, 59 aa, Homo sapiens
QPLRSSQFEVKTYDPSGDSTLPTCSKKRKIEQVDKEDEITEKKAKKAKIKVKVEEETQT

SEQ ID NO: 873063 - protein, 529 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873064 - protein, 529 aa, Homo sapiens; identical to SEQ ID NO: 873063

SEQ ID NO: 873065 - protein, 521 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIAVCLFLIIG

SEQ ID NO: 873066 - protein, 466 aa, Homo sapiens
MEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873067 - protein, 466 aa, Homo sapiens; identical to SEQ ID NO: 873066

SEQ ID NO: 873068 - protein, 331 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGDGFNVICKYECLKYFLVRILFTSLNYSC

SEQ ID NO: 873069 - protein, 545 aa, Homo sapiens
MMSEFTVGSSDRPVVHNSVVFSRIAVPRFNIIATVVMDTSFSLHSIVLYVQISSKLGSCYENDRFRFALSDHRSESACTPGRTSHCFMNELEPELIDSSDFFVFFAATIFLPEERDGPQPTAAAKMAVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873070 - protein, 451 aa, Homo sapiens
GCSEFGTSGTRADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873071 - protein, 285 aa, Homo sapiens
PGNRGRRRCIFCSLHPVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873072 - protein, 172 aa, Homo sapiens
GGGWVNRTRVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873073 - protein, 145 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHR

SEQ ID NO: 873074 - protein, 117 aa, Homo sapiens
MRGRVDYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873075 - protein, 171 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLARIRLKEALISHHDGRNPGNDWIKL

SEQ ID NO: 873076 - protein, 529 aa, Homo sapiens; identical to SEQ ID NO: 873063

SEQ ID NO: 873077 - protein, 529 aa, Homo sapiens; identical to SEQ ID NO: 873063

SEQ ID NO: 873078 - protein, 529 aa, Homo sapiens; identical to SEQ ID NO: 873063

SEQ ID NO: 873079 - protein, 494 aa, Homo sapiens
MRRNFKRLIVYGKNLKLQRKQTKSFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873080 - protein, 366 aa, Homo sapiens [sequence omitted]

SEQ ID NO: 873081 - protein, 369 aa, Homo sapiens
MIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873082 - protein, 169 aa, Homo sapiens [sequence omitted]

SEQ ID NO: 873083 - protein, 162 aa, Homo sapiens
GLLLLNSRPVDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 873084 - protein, 103 aa, Homo sapiens
RVARVGWLGAFLPSQVDCLRAPESPCSHSYPRLQAEGREGLGTFPLPFPPLQLQFPWPPLGIWKSLGNLKKIFLESLSIAPQPCEGATAKRKKEKEWVGVTRG

SEQ ID NO: 873085 - protein, 262 aa, Homo sapiens
KVDGSALSCCRKWEERKVVMAAIAASEVLVDSAEEGSLAAAAELAAQKREQRLRKFRELHLMRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 873086 - protein, 262 aa, Homo sapiens; identical to SEQ ID NO: 873085

SEQ ID NO: 873087 - protein, 220 aa, Homo sapiens
KVDGSALSCCRKWEERKVVMAAIAASEVLVDSAEEGSLAAAAELAAQKREQRLRKFRELHLMRECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 873088 - protein, 93 aa, Homo sapiens
RRGTKEEEKVEVPLHGLLHGTHVPSTEEIDRMVIDLEKQIEKRDKYSRRRPYNDDADIDYINERNAKFNKKAERFYGKYTAEIKQNLERGTAV

SEQ ID NO: 873089 - protein, 262 aa, Homo sapiens; identical to SEQ ID NO: 873085

SEQ ID NO: 873090 - protein, 93 aa, Homo sapiens
KVDGSALSCCRKWEERKVVMAAIAASEVLVDSAEEGSLAAAAELAAQKREQRLRKFRELHLMRVSSLGGRLRSVIWPSLCAFVEGTRKPHHCV

SEQ ID NO: 873091 - protein, 201 aa, Homo sapiens
MRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 873092 - protein, 115 aa, Homo sapiens
KVDGSALSCCRKWEERKVVMAAIAASEVLVDSAEEGSLAAAAELAAQKREQRLRKFRELHLMRNEARKLNHQEVAEKGKKSGDEEGRGKEKAAKQWFGWAVFQSIPPFKILIKYS

SEQ ID NO: 873093 - protein, 321 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLC

SEQ ID NO: 873094 - protein, 130 aa, Homo sapiens
VLDPMGAQQSQRCNLGHLWTSANGGVSSVEAVVGEDVLEKPSSGASVGTCPRGTASLTLSRVLSSLPASYVITDLTQLRKIKSMERVQGVSITRELLWWWGMRQATVQQLVDLLCRLELYRAAQIILNCE

SEQ ID NO: 873095 - protein, 72 aa, Homo sapiens
KWKAPLRSLFRASLRDSLAHHPRLPVECPRRSGAAVTLAVRTEEEAPWGAGRRRTIRPSASRTWAENPPAPR

SEQ ID NO: 873096 - protein, 101 aa, Homo sapiens
PQGGGLRRGSEKALGREGTRGGARGAAFPRVVVLRGTWKGMADKLPTTVGNKDTGAERVLTRGFKIWRRGATGKAETGVYIPGKCQSLASPAPPLRFLCSL

SEQ ID NO: 873097 - protein, 541 aa, Homo sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTGEKPYECSKCGKAFSDGSALTQHQRIHTGEKPYECLECGKTFNRNSSLILHQRTHTGEKPYRCNECGKPFTDISHLTVHLRIHTGEKPYECSKCGKAFRDGSYLTQHERTHTGEKPFECAECGKSFNRNSHLIVHQKIHSGEKPYECKECGKTFIESAYLIRHQRIHTGEKPYGCNQCQKLFRNIAGLIRHQRTHTGEKPYECNQCGKAFRDSSCLTKHQRIHTKETPYQCPECGKSFKQNSHLAVHQRLHSREGPSRCPQCGKMFQKSSSLVRHQRAHLGEQPMET

SEQ ID NO: 873098 - protein, 541 aa, Homo sapiens; identical to SEQ ID NO: 873097

SEQ ID NO: 873099 - protein, 147 aa, Homo sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPL

SEQ ID NO: 873100 - protein, 541 aa, Homo sapiens; identical to SEQ ID NO: 873097

SEQ ID NO: 873101 - protein, 541 aa, Homo sapiens; identical to SEQ ID NO: 873097

SEQ ID NO: 873102 - protein, 634 aa, Homo sapiens
AGVGRALAALLLAASVLSAALLPPAALRGAMPRLRPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 873103 - protein, 634 aa, Homo sapiens; identical to SEQ ID NO: 873102

SEQ ID NO: 873104 - protein, 265 aa, Homo sapiens
NSTRRYAVCYFSHEGSGSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 873105 - protein, 634 aa, Homo sapiens; identical to SEQ ID NO: 873102

SEQ ID NO: 873106 - protein, 634 aa, Homo sapiens; identical to SEQ ID NO: 873102

SEQ ID NO: 873107 - protein, 634 aa, Homo sapiens; identical to SEQ ID NO: 873102

SEQ ID NO: 873108 - protein, 634 aa, Homo sapiens; identical to SEQ ID NO: 873102

SEQ ID NO: 873109 - protein, 196 aa, Homo sapiens
LEGEDFREEFFRKTVLLLNSHPACTCLLDPSTWRPAHVSGPALASSPQILSVFSLGFPGFVNGSCVSRYKPDIIFPPGLPPPDLPSSVSIFYLQLLCSHGHCCITESGPLLSFSNWPPSLVPHFLKSPVHCHQIKLSPARSPLSEKPPLTWKHHCLAHILTYSPSRLDPHTSFQPPLPLHSLLPPPPPHPLVSPPL

SEQ ID NO: 873110 - protein, 634 aa, Homo sapiens; identical to SEQ ID NO: 873102

SEQ ID NO: 873111 - protein, 634 aa, Homo sapiens; identical to SEQ ID NO: 873102

SEQ ID NO: 873112 - protein, 634 aa, Homo sapiens; identical to SEQ ID NO: 873102

SEQ ID NO: 873113 - protein, 514 aa, Homo sapiens
AGVGRALAALLLAASVLSAALLPPAALRGAMPRLRPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQVFVHFIRLLFLTIYDILFTHLKTISLK

SEQ ID NO: 873114 - protein, 673 aa, Homo sapiens
AGVGRALAALLLAASVLSAALLPPAALRGAMPRLRPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLRVLLCHPGWSAVAPSRLTPSSASRVHTILLPQPPEYWNCSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 873115 - protein, 339 aa, Homo sapiens [sequence omitted]

SEQ ID NO: 873116 - protein, 634 aa, Homo sapiens; identical to SEQ ID NO: 873102

SEQ ID NO: 873117 - protein, 634 aa, Homo sapiens; identical to SEQ ID NO: 873102

SEQ ID NO: 873118 - protein, 634 aa, Homo sapiens; identical to SEQ ID NO: 873102

SEQ ID NO: 873119 - protein, 163 aa, Homo sapiens
TDRIEPVPRLASSPQILSVFSLGFPGFVNGSCVSRYKPDIIFPPGLPPPDLPSSVSIFYLQLLCSHGHCCITESGPLLSFSNWPPSLVPHFLKSPVHCHQIKLSPARSPLSEKPPLTWKHHCLAHILTYSPSRLDPHTSFQPPLPLHSLLPPPPPHPLVSPPL

SEQ ID NO: 873120 - protein, 68 aa, Homo sapiens
KLCKTLIRSDHKHDIPKQLRKMEQQTEDIFNMVLGDTFGKDAFPSRGQHCGEIGPEPLLAQLSRSFAF

SEQ ID NO: 873121 - protein, 531 aa, Homo sapiens
AGVGRALAALLLAASVLSAALLPPAALRGAMPRLRPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILVSKQHSSLKFLSFTCIDI

SEQ ID NO: 873122 - protein, 283 aa, Homo sapiens
AGVGRALAALLLAASVLSAALLPPAALRGAMPRLRPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPW

SEQ ID NO: 873123 - protein, 206 aa, Homo sapiens
MALGLCRCFHPRHSMAAFGLFPALPSALNSHPACTCLLDPSTWRPAHVSGPALASSPQILSVFSLGFPGFVNGSCVSRYKPDIIFPPGLPPPDLPSSVSIFYLQLLCSHGHCCITESGPLLSFSNWPPSLVPHFLKSPVHCHQIKLSPARSPLSEKPPLTWKHHCLAHILTYSPSRLDPHTSFQPPLPLHSLLPPPPPHPLVSPPL

SEQ ID NO: 873124 - protein, 74 aa, Homo sapiens
GSLGHSTLCPCCGWEPWVLHGTLRAGRIRPNLSPRGKQPLPAERVGLGQEARGEWGVGTIRNPSRGCQGRLHLL

SEQ ID NO: 873125 - protein, 269 aa, Homo sapiens
DQRGTCHQFQFCPSWPEAARDFPGWKDRSGGQATWRQGQVLRTPSPAQLSAGEAALGSWSGLATEVCASLAALISPGALEQVFLRLPTHQPRPKIITTKDVLGPLSPQNESFKNSCPEVSEKNSRMRVRGTRPSALPRLKDEVETTKAPKTKPSSPHLQAVPKEGKRGMGWGGRVEPPPRAVSTGVSREAGPWPGSASDRTDRVLGRSVVKLASNPQTTKTASFPSSVLMLLRPAEESSASPAERSQASCQRRGRRKPQVPGDPSPKFA

SEQ ID NO: 873126 - protein, 1692 aa, Homo sapiens
ERTAAAEAAAAGPRSDSRSCSGGERSRAAAGREVSGAELNVQQWMTTAWMSLWPGAQGRMDTHRSALRTRQVTLKKAAWGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILKKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 873127 - protein, 892 aa, Homo sapiens
ERTAAAEAAAAGPRSDSRSCSGGERSRAAAGREVSGAELNVQQWMTTAWMSLWPGAQGRMDTHRSALRTRQVTLKKAAWGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILKKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPEG

SEQ ID NO: 873128 - protein, 123 aa, Homo sapiens
SGPEHLDVKGHLVIAPLSPDLPQQEWRDQPREGGQPGEGVRGQVQAHAQAQETRGRGGAAHAGGRGLRPGNHGLCPGSCREWRESGPCPGSCREWRESGPCPGSCREWREMGGITMPAVGFLR

SEQ ID NO: 873129 - protein, 1604 aa, Homo sapiens
ERTAAAEAAAAGPRSDSRSCSGGERSRAAAGREVSGAELNVQQWMTTAWMSLWPGAQGRMDTHRSALRTRQVTLKKAAWGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILKKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDAGPHRGQAGVLRAALSQSRASGTRVPRHRPLSGLQPRPAACPGPALKHPIKPFYQKREVTKEEYKDILRKAVQKICHSKSGEINPVKVANLVKAYVDKYRHMRRHKKPEAGEEPPTQGAEG

SEQ ID NO: 873130 - protein, 948 aa, Homo sapiens
ERTAAAEAAAAGPRSDSRSCSGGERSRAAAGREVSGAELNVQQWMTTAWMSLWPGAQGRMDTHRSALRTRQVTLKKAAWGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILKKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQRCQAPMSQCGAGASPEASAQKRQTSLSYPGYQRSGEMTVVADGSGPAQGQSIEIPVPDQRLTGREGRAAGEAHGKASTGAG

SEQ ID NO: 873131 - protein, 167 aa, Homo sapiens
AALNGNTELISLLLEAQAAVDIKDNKGMRPLHYAAWQGRKEPMKLVLKAGSAVNIPSDEGHIPLHLAAQHGHYDVSEMLLQHQSNPCMVDNSGKTPLDLACEFGRVGVVQLLLSSNMCAALLEPRPGDATDPNGTSPLHLAAKNGHIDIIRLLLQAGIDINRQTKSG

SEQ ID NO: 873132 - protein, 199 aa, Homo sapiens
AALNGNTELISLLLEAQAAVDIKDNKGMRPLHYAAWQGRKEPMKLVLKAGSAVNIPSDEGHIPLHLAAQHGHYDVSEMLLQHQSNPCMVDNSGKTPLDLACEFGRVGVVQLLLSSNMCAALLEPRPGDATDPNGTSPLHLAAKNGHIDIIRYEPVAGRASALGVPRGFSSSLGLQGHQFLAGDKGREQGQGPRSLVQAS

SEQ ID NO: 873133 - protein, 83 aa, Homo sapiens
APGPGLRVRPRWGESPVEPCGVGLGSPTSGPPYPDPSFKVVQLLLSSNMCAALLEPRPGDATDPNGTSPLHLAAKNGHIDIIR

SEQ ID NO: 873134 - protein, 815 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 873135 - protein, 815 aa, Homo sapiens; identical to SEQ ID NO: 873134

SEQ ID NO: 873136 - protein, 779 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEVSEGKAKSVGEAEDGPEGRGDGTCEEGSSGAEHWQDEEREKGEKDKGRGEMERPGEGEKELAEKEEWKKRDGEEQEQKEREQGHQKERNQEMEEGGEEEHGEGEEEEETDREEEEERGGRRERSRKSSTAEEPEEEGDSASSMR

SEQ ID NO: 873137 - protein, 440 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERLSLMSSGSLYTINNEMGKQRNKDFN

SEQ ID NO: 873138 - protein, 828 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEYSASHSQIVSVEKDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 873139 - protein, 560 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEENCGR

SEQ ID NO: 873140 - protein, 225 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTSKTHFEVIMLSPTSMLLLN

SEQ ID NO: 873141 - protein, 119 aa, Homo sapiens
PSCEDEIENSGFWLGDRVTEQPRGDSAGGPRAGTGWDRGALFSERCLPRSPLRGTGGCQLGPQPWVPRLLARGLRCRRGLGTGPAGPDRVSGAQRCRAGGAAGEPPDSASRGSWSLMDR

SEQ ID NO: 873142 - protein, 115 aa, Homo sapiens
PSQSGPGGDQEVSGKHKLCSGAGEAWPAQPVLSVMGTALEVTPLSSGIWIRWGLLQTSVLSRCDRRPLECSPGSSTGPSRWELRGNRGSQRGTWSTSPGPSTLPAFPALHWIKPV

SEQ ID NO: 873143 - protein, 653 aa, Homo sapiens
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYASQDLHEDVEEAGALQKNHALVTSANSTEAADSAFLPTEDESLSTMSCEMLTEQTPSSDPENALEVNGAEVTGEKENHCDDKTCVPSTSAEDMSENVPIAEDTTEQPKKNRITYSQIIKEGRRFNIDLVSKLLYSRGLLIDLLIKSNVSRYAEFKNITRILAFREGRVEQVPCSRADVFNSKQLTMVEKRMLMKFLTFCMEYEKYPDEYKGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 873144 - protein, 358 aa, Homo sapiens
RRRPRRASSTSEARPCSSGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 873145 - protein, 97 aa, Homo sapiens
PGLQDSARASEFDVIVIGTGLPESIIAAACSRSGRRVLHVDSRSYYGGNWASFSFSGLLSWLKEYQENSDIVSDSPVWQDQILENEEAIALSRKDKM

SEQ ID NO: 873146 - protein, 117 aa, Homo sapiens
PGLQDSARASEFDVIVIGTGLPESIIAAACSRSGRRVLHVDSRSYYGGNWASFSFSGLLSWLKEYQENSDIVSDSPVWQDQILENEEAIALSRKDKTIQHVEVFCYARYEKYLLQVN

SEQ ID NO: 873147 - protein, 436 aa, Homo sapiens
EFRLKTSALEHGTCSTRPSRNARILVIFLNSAYRLTLDLIRRSISNPREYSSFDTKSILNLLHVFNSKQLTMVEKRMLMKFLTFCMEYEKYPDEYKGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 873148 - protein, 110 aa, Homo sapiens
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYARSTLLL

SEQ ID NO: 873149 - protein, 197 aa, Homo sapiens
MPRRGLILHTRTHWLLLGLALLCSLVLFMYLLECAPQTDGNASLPGVVGENYGKEYYQALLQEQEEHYQTRATSLKRQIAQLKQELQEMSEKMRSLQERRNVGANGIGYQSNKEQAPSDLLEFLHSQIDKAEVSIGAKLPSEYGVIPFESFTLMKVFQLEMGLTRHPEEKPVRKDKRDELVEVIEAGLEVINNPDED

SEQ ID NO: 873150 - protein, 113 aa, Homo sapiens
PTPALPVLPHPSLPGERPLQEAVAFLCWLLVDVLLKATVSKVGGGSALASVARVMKAQAFSPLLRILHKASTSSFRARKDSAHTPSCLLTPSGPERAGPLTQDSCQPSPHDSF

SEQ ID NO: 873151 - protein, 754 aa, Homo sapiens
YKIISIKGEMLPFAPQDEPWDREMEVFSGGGASSGEVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKDLLSHMLHMDPHQRYTAEQILKHSWITHRDQLPNDQPKRNDVSHVVKGAMVATYSALTHKTFQPVLEPVAASSLAQRRSMKKRTSTGL

SEQ ID NO: 873152 - protein, 698 aa, Homo sapiens
MGLSTSAIWKNTRVEIVNPYEVKRKVKVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKGAMVATYSALTHKTFQPVLEPVAASSLAQRRSMKKRTSTGL

SEQ ID NO: 873153 - protein, 1099 aa, Homo sapiens [sequence omitted]

SEQ ID NO: 873154 - protein, 427 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVIIIGLSVVVTTLTGISMSAICTNGVVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEVRCLLCFAVLGVVVHLVGSTRS

SEQ ID NO: 873155 - protein, 182 aa, Homo sapiens
LRISFRPGNQECYDNFLQSGETAKTDASFHAYDSHTNTYYLQTFGHNTMDAVPKIEYYRNTGSISGPKVNRPSLLEIHEQLAKVSLKDTSKSPPLFITSDNFLLFHYTMNECETVKWRGLFQTLSILLTKLSLVPRKVFHRCFFFGFFFFLRQSLALSPSLKCGGHCSFELLGSNNPPTSTS

SEQ ID NO: 873156 - protein, 217 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIEYPSWHDW

SEQ ID NO: 873157 - protein, 890 aa, Homo sapiens
GLGVIIIGLAVTVTGITGLSTSAIATNGCVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIAMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 873158 - protein, 32 aa, Homo sapiens
AGGLGPLSLRQQLASGSYNEQFFGPGTRLTVH

SEQ ID NO: 873159 - protein, 31 aa, Homo sapiens
ELGDSALYLCASSWTADTEAFFGQGTRLTVV

SEQ ID NO: 873160 - protein, 36 aa, Homo sapiens
TSSQTSVYFCAISDGTVELWLHLRFGDQVNRCRGRL

SEQ ID NO: 873161 - protein, 33 aa, Homo sapiens
SWGTRPFIFAPAAGQRTDTQYFGPGTRLTVLED

SEQ ID NO: 873162 - protein, 30 aa, Homo sapiens
AGGLGPLSLRQQLASDNEKLFFGSGTQLSV

SEQ ID NO: 873163 - protein, 41 aa, Homo sapiens
SFVTLLCISVPAAEGGWSPLHFGNGTRLTVTEDLNKVFPPE

SEQ ID NO: 873164 - protein, 32 aa, Homo sapiens
AGGLGPLSLRQQLASEGYYEQYFGPGTRLTVT

SEQ ID NO: 873165 - protein, 36 aa, Homo sapiens
TSSQTSVYFCAISDGTVGCNQPQHFGDGTRLSILED

SEQ ID NO: 873166 - protein, 34 aa, Homo sapiens
SFVTLLCISVPAARAQANTGELFFGEGSRLTVLG

SEQ ID NO: 873167 - protein, 35 aa, Homo sapiens
LQNWRILEFIFCASSQGCNQPQHFGDGTRLSILED

SEQ ID NO: 873168 - protein, 35 aa, Homo sapiens
ELGDSALYLCASSWTAGCNQPQHFGDGTRLSILED

SEQ ID NO: 873169 - protein, 35 aa, Homo sapiens
LQNWRILEFIFCASSQQANTGELFFGEGSRLTVLG

SEQ ID NO: 873170 - protein, 33 aa, Homo sapiens
SFVTLLCISVPAAKQRGSYNEQFFGPGTRLTVH

SEQ ID NO: 873171 - protein, 35 aa, Homo sapiens
ELGDSALYLCASSWTAQANTGELFFGEGSRLTVLG

SEQ ID NO: 873172 - protein, 42 aa, Homo sapiens
AAASQTSVYFCAISEAAMLREFLAANTGELFFGEGSRLTVLG

SEQ ID NO: 873173 - protein, 38 aa, Homo sapiens
KRTRQLSISVPVPPHGVRVANYGYTFGSGTRLTVVEDG

SEQ ID NO: 873174 - protein, 31 aa, Homo sapiens
RRLSPVSLRQQPRQRSYNEQFFGPGTRLTVH

SEQ ID NO: 873175 - protein, 30 aa, Homo sapiens
PEDSALYLCASSQDSDTEAFFGQGTRLTVV

SEQ ID NO: 873176 - protein, 32 aa, Homo sapiens
HGDSALYFCASIVGMFRETQYFGPGTRLLVLG

SEQ ID NO: 873177 - protein, 31 aa, Homo sapiens
GRLGCVSLCQKLSTALCSGNTIYFGEGSWLT

SEQ ID NO: 873178 - protein, 70 aa, Homo sapiens
SLDQGLQFLIQYYNGEERAKGNILERFSAQQFPDLHSELNLSSLELGDSALYFCASSRSTALHEHQPSVQ

SEQ ID NO: 873179 - protein, 36 aa, Homo sapiens
LQNWRILEFIFCASSQLGTSETQYFGPGTRLTVLED

SEQ ID NO: 873180 - protein, 33 aa, Homo sapiens
SFVTLLCISVPAAKQREGYYEQYFGPGTRLTVT

SEQ ID NO: 873181 - protein, 35 aa, Homo sapiens
LQNWRILEFIFCASSQELWLHLRFGDQVNRCRGRL

SEQ ID NO: 873182 - protein, 31 aa, Homo sapiens
ELRDSAVYFCASSQAAGTLKLSLDKAPDSQL

SEQ ID NO: 873183 - protein, 34 aa, Homo sapiens
SFVTLLCISVPAARAGCNQPQHFGDGTRLSILED

SEQ ID NO: 873184 - protein, 34 aa, Homo sapiens
SFVTLLCISVPAARAELWLHLRFGDQVNRCRGRL

SEQ ID NO: 873185 - protein, 40 aa, Homo sapiens
ELGDSALYLCASSWTAPGEGEHFTPPLWERDQAHCDRGPE

SEQ ID NO: 873186 - protein, 34 aa, Homo sapiens
TSSQTSVYFCAISDGTVGATMSSSSGQGHGSPCI

SEQ ID NO: 873187 - protein, 35 aa, Homo sapiens
AAPSQTSVYFCASSEGERQGYYEQYFGPGTRLTVT

SEQ ID NO: 873188 - protein, 33 aa, Homo sapiens
LQNWRILEFIFCASSQHRYAVFWPRHPADSARG

SEQ ID NO: 873189 - protein, 77 aa, Homo sapiens
SLDQGLQFLIQYYNGEERAKGNILERFSAQQFPDLHSELNLSSLELGDSALYFCASSEAQPFWGQRPDFRGRQQADR

SEQ ID NO: 873190 - protein, 38 aa, Homo sapiens
CCLPDICVLLCQQLPYLWGNWKGYYEQYFGPGTRLTVT

SEQ ID NO: 873191 - protein, 32 aa, Homo sapiens
ELRDSAVYFCASSQSKGYYEQYFGPGTRLTVT

SEQ ID NO: 873192 - protein, 32 aa, Homo sapiens
TSSQTSVYFCAISDGTVDTEAFFGQGTRLTVV

SEQ ID NO: 873193 - protein, 30 aa, Homo sapiens
PGTQLCIFVLVSEEGQTLKLSLDKAPDSQL

SEQ ID NO: 873194 - protein, 31 aa, Homo sapiens
QGDLAVYLCASSSATADTEAFFGQGTRLTVV

SEQ ID NO: 873195 - protein, 31 aa, Homo sapiens
GDSALYLCASSDRTRLVGETQYFGAGTRLSV

SEQ ID NO: 873196 - protein, 42 aa, Homo sapiens
RDSAMYRCASSLSGSGLNSPLHFGNGTRLTVTEDLNKVFPPE

SEQ ID NO: 873197 - protein, 240 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVRAEDLRSPLWGWRGTGGFSGQELVKLCSKKDKDNAATLKCWDRGAGNT

SEQ ID NO: 873198 - protein, 240 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKAKYLKTFTTSDFKEFFRSLGWMTCRLPQKIR

SEQ ID NO: 873199 - protein, 594 aa, Homo sapiens
MYSPIIYQALCEHVQTQMSLMNDLTSKNIPNGIPAVPCHAPSHSESQATPHSSYGLCTSTPVWSLQRPPCPPKVHSEVQTDGNSQFASQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873200 - protein, 1086 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873201 - protein, 753 aa, Homo sapiens
MYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873202 - protein, 1022 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSEKSASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873203 - protein, 736 aa, Homo sapiens
MSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873204 - protein, 735 aa, Homo sapiens
VTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873205 - protein, 1086 aa, Homo sapiens; identical to SEQ ID NO: 873200

SEQ ID NO: 873206 - protein, 1069 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873207 - protein, 946 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQHHWLRMATPHHGC

SEQ ID NO: 873208 - protein, 737 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIGTYLDSSY

SEQ ID NO: 873209 - protein, 658 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLECR

SEQ ID NO: 873210 - protein, 304 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETCKPFFS

SEQ ID NO: 873211 - protein, 193 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQTF

SEQ ID NO: 873212 - protein, 927 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873213 - protein, 594 aa, Homo sapiens; identical to SEQ ID NO: 873199

SEQ ID NO: 873214 - protein, 1045 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873215 - protein, 1021 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKSAETVHGLDGCASLLRDILRNEDSASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873216 - protein, 679 aa, Homo sapiens
MYSPIIYQALCEHVQTQMSLMNDLTSKNIPNGIPAVPCHAPSHSESQATPHSSYGLCTSTPVWSLQRPPCPPKVHSEVQTDGNSQFASQETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873217 - protein, 1013 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLEYLEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 873218 - protein, 1086 aa, Homo sapiens; identical to SEQ ID NO: 873200

SEQ ID NO: 873219 - protein, 833 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRLFKTVDLNVLQSLTQKPNTVHELRKSRTALNKEEVGDLSPGPSTHFNFSHLLGIWGSAA

SEQ ID NO: 873220 - protein, 582 aa, Homo sapiens
QPRGLIFIEYQEQNLPKGTRCQTKNKERKPKKSRSIPSETYSPPTPVPSSGAGGSSSPFSPPQVLEPPLNSFLGGSAPAPPQPCLGPAPFAVYWLLPTPAVWVTSREAWRGLLRTPKALGLEQEKGSGGASETMKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQG

SEQ ID NO: 873221 - protein, 75 aa, Homo sapiens
PVAAHPPGRGPAHLRHWRRGYWSGPYPTLLPDAGLSGNLSDLCRVLIAPFNPGHFSQVHKDSGEKEHPRWSMKAM

SEQ ID NO: 873222 - protein, 111 aa, Homo sapiens
SAVILGTQTPRLEEAGDTSRLEFLPREGDAANWPGDRSQRSVVYAGTSTWGQGCLHMDWVGIPLQGQALFFPPPARRGLVSWFTNKSGAFVLFISRGSQSPLSFFCEQVIS

SEQ ID NO: 873223 - protein, 210 aa, Homo sapiens
CEEKERRTAAFWGKPRSRGSLSQVCDSLFGALWFLASLNFQASPCSPCPDTVPAACMLYIWSSLSLSRSWHLCWLLELPTRHSSWRAWLCAADGPSTCLPTHFSPLRAWLVFGRCGIPASSKSQVQPARPSRQNKPSRPEQKLGRRYHQPQRFPAGEVTPQRSCDITGCILRNTEHIYSDMAKQTGKQNKNMIKTFYSQNSEVSADNMHT

SEQ ID NO: 873224 - protein, 167 aa, Homo sapiens [sequence omitted]

SEQ ID NO: 873225 - protein, 109 aa, Homo sapiens
AHYFSVILLTCIMFTGTASSAGQDQEYRGSRPGVGSKLGAELQRARVPGDPNRFCLQQTCCSAPSQHTPDAETRPLPCLPCAWYLQGTENRAVGMKSGTWRARGRPRSY

SEQ ID NO: 873226 - protein, 87 aa, Homo sapiens
TGQSYRGRGLWKTGRDFEDLGLVDGELTWGGEGGGATLGSWAKSSPGRLRYPCACVAHKLVVRRTRLGGIAPGRSERGRAWSAAAAG

SEQ ID NO: 873227 - protein, 119 aa, Homo sapiens
MNLTHIYRTFYLTDAEYIFFSSAHGSFSRTDHMLRHRQASKYLKSQNQSHILSDNIGMKLEVNNKRNFGNYINSCKLNTMLLNDHWVNEEIKIKIQKFLKTNENRNTTYQNLWDTAKAV

SEQ ID NO: 873228 - protein, 130 aa, Homo sapiens
TFEKWFLFLLNDPDMYIYLYHGKRPSSESHSCIRVLAFGDKDFSLLTCAVPTAYVLCGICHSSFVSVLCLLNWRLSFLMVCRTRLSESSFQNSVALVSLYTISLRKHPTLCCCPEVWAVLEAYPFLSGTA

SEQ ID NO: 873229 - protein, 433 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 873230 - protein, 433 aa, Homo sapiens; identical to SEQ ID NO: 873229

SEQ ID NO: 873231 - protein, 393 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 873232 - protein, 240 aa, Homo sapiens
SGAGARVSAGLRPAEQRDLAAGVLVWGREQTLLLKSHWPLVLGRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 873233 - protein, 313 aa, Homo sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQGKR

SEQ ID NO: 873234 - protein, 433 aa, Homo sapiens; identical to SEQ ID NO: 873229

SEQ ID NO: 873235 - protein, 396 aa, Homo sapiens
VTLQDLPNTAISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 873236 - protein, 200 aa, Homo sapiens
MCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873237 - protein, 745 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873238 - protein, 686 aa, Homo sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873239 - protein, 575 aa, Homo sapiens
YLFLKKVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873240 - protein, 684 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLVSSSLLPPKSSSES

SEQ ID NO: 873241 - protein, 708 aa, Homo sapiens
TRLVEAAVNRTRAREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873242 - protein, 727 aa, Homo sapiens
AANGRQPNLPPPSPPPRALPAHFRLCARSTSGAEPESARARGAGAERGEHREGERGAAGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873243 - protein, 684 aa, Homo sapiens; identical to SEQ ID NO: 873240

SEQ ID NO: 873244 - protein, 688 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNE

SEQ ID NO: 873245 - protein, 704 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLQMSSGGAQLMLLKFLRYISLYSSWIFWMKEHSWQ

SEQ ID NO: 873246 - protein, 688 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLDDIIAQLPPPIKKKKFGT

SEQ ID NO: 873247 - protein, 656 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKVFEYSIPDKQYTDWSRTVQKQGFHHLWLQRDTPITHISFHPKRPMHILLHDAYMFCIIDKSLDDIIAQLPPPIKKKKFGT

SEQ ID NO: 873248 - protein, 630 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873249 - protein, 745 aa, Homo sapiens; identical to SEQ ID NO: 873237

SEQ ID NO: 873250 - protein, 456 aa, Homo sapiens
EKIRGVYSFVISVRGTRRLVCKLHGAVGCQSIIQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 873251 - protein, 500 aa, Homo sapiens
AANGRQPNLPPPSPPPRALPAHFRLCARSTSGAEPESARARGAGAERGEHREGERGAAGMGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDDDIIAQLPPPIKKKKFGT

SEQ ID NO: 873252 - protein, 1041 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873253 - protein, 579 aa, Homo sapiens
RKTLARRRPGLIRQRLHNVILAELNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873254 - protein, 1041 aa, Homo sapiens; identical to SEQ ID NO: 873252

SEQ ID NO: 873255 - protein, 202 aa, Homo sapiens
SSVPLSSWQHLFYGQWRQVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873256 - protein, 933 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPQSLIFKGYPLSLRKPLKCFKL

SEQ ID NO: 873257 - protein, 80 aa, Homo sapiens
GRVGRPTRRTHASATSKYEEDYYEDDEEDDPDALKDPLYQIDLQAYLTDFLCQFAQQPCYIMFSGHLNDNERRVLQTIGI

SEQ ID NO: 873258 - protein, 923 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPEAGQTFLCWISRSSEILR

SEQ ID NO: 873259 - protein, 997 aa, Homo sapiens
PSGRRPRSEKEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873260 - protein, 832 aa, Homo sapiens
SEDPKSALFYITICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873261 - protein, 1041 aa, Homo sapiens; identical to SEQ ID NO: 873252

SEQ ID NO: 873262 - protein, 1024 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873263 - protein, 1087 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFEASSRVLIRWMIGRPRCAVCICSMSRRPDNSSQQSTGQSQEIYAPRSTRVAPCYPSRVTSNLTRPDTIALRTLWPHVSESVTCDAGVPHVFVKARGYQWAPKLSRQWERLDLSANCLVSGQINWQSSTADRDSCQGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873264 - protein, 1139 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQVESSGEWASYSLADRNENSYFGPELFYPLTSLVGQLSKMDLSDLFGLRNMDKEISHVFLSVDNTLSVDCISYLTGQFPLISYVSEIDFPEANVLIFSYSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873265 - protein, 1041 aa, Homo sapiens; identical to SEQ ID NO: 873252

SEQ ID NO: 873266 - protein, 969 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQGAPGPYSQETFSLADQVTNCQIINL

SEQ ID NO: 873267 - protein, 164 aa, Homo sapiens
KSLSTLISPGSFIETNQEGLAISDSLSLGTTSHIAEAFGALLFWPIWIWGGKMHECALALAAFHLQVDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 873268 - protein, 797 aa, Homo sapiens
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 873269 - protein, 797 aa, Homo sapiens; identical to SEQ ID NO: 873268

SEQ ID NO: 873270 - protein, 158 aa, Homo sapiens
ERPNGTSAQPAQVKPEFYRQAELKPCPWTGSNQRRCITFCPTPDQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 873271 - protein, 131 aa, Homo sapiens
QTRLTHLPAILPMANGLFRRRPWGLEQIRPDPESEGLFDKPPPEDPPAARGPRSASAAGKKAGRRAGGRAQGGRAGQPPKAASRPPPKKEAPPLDEGCYLDHFPHLSIFIYAAIAFSITSCIFTYIHLQLA

SEQ ID NO: 873272 - protein, 131 aa, Homo sapiens; identical to SEQ ID NO: 873271

SEQ ID NO: 873273 - protein, 785 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 873274 - protein, 373 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKN

SEQ ID NO: 873275 - protein, 767 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 873276 - protein, 785 aa, Homo sapiens; identical to SEQ ID NO: 873273

SEQ ID NO: 873277 - protein, 785 aa, Homo sapiens; identical to SEQ ID NO: 873273

SEQ ID NO: 873278 - protein, 636 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEAGSAV

SEQ ID NO: 873279 - protein, 304 aa, Homo sapiens
MKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 873280 - protein, 586 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGYTSRGTGSI

SEQ ID NO: 873281 - protein, 785 aa, Homo sapiens; identical to SEQ ID NO: 873273

SEQ ID NO: 873282 - protein, 785 aa, Homo sapiens; identical to SEQ ID NO: 873273

SEQ ID NO: 873283 - protein, 785 aa, Homo sapiens; identical to SEQ ID NO: 873273

SEQ ID NO: 873284 - protein, 768 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENLFDDSEVKVTEEKDFLNSLSPSTSPTSTPYLLFYKKL

SEQ ID NO: 873285 - protein, 666 aa, Homo sapiens
QSSSHQEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 873286 - protein, 376 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKYKKL

SEQ ID NO: 873287 - protein, 103 aa, Homo sapiens
RKRNILHHLLFTNLFGMPLMISESPGSVCTYSAVFSAHCVQFNIIATVVMNTTFGQHGTVSYFGFPQSGAVVGEHNQFHFALSDHLWSLLVPQHILYTFFVFV

SEQ ID NO: 873288 - protein, 112 aa, Homo sapiens
KHMCTHTQMHTLTNAHTHRDPHTNAHSHTQTHTQMYTHTRTHTQMDTLTYVYCHTHIHINIHMHIYPHACVHTCSPISPPGVKLSLRELPHTPQIPLSQLLRSLCSSSFVKV

SEQ ID NO: 873289 - protein, 43 aa, Homo sapiens
RLKPNVHSKLTCTRKAGRRGCGSGTRYFLVSLPPLPRYSCNTL

SEQ ID NO: 873290 - protein, 796 aa, Homo sapiens
METPLPKAPEKRQVTAIIFLLLLWEAGSATIKYSVLEERDSGSFVANLAKDLGLGVGELAARGARILSKGNKQYLQLERKSGNLLLKEKLDREELCGDIDPCILHFQMLLKNPVQFIQGELQLQDVNDHAPEFLENEILLKISEGSHPGTSFPLKIAQDLDVGSNTVQNYSISTNSYFHLFTRNHSDGKKYPELVLDQALDREEQPQLRLTLTALDGGSPPRTGTSQVLIVIVDINDNVPEFAQRRYEVQVPENTPIGSLVITVSARDLDAGTHGELSYSFFQYSNQIIQAFEINSITGEIRFKKALDFEEIQSYHMEVEASDGGGLSGKCTVAIEVMDINDNAPELTMSLLISDILENSPETVVAVFGISDPDSGNNGKMMCSIQDHLPFLLKPTLENFYTLLTEGALDRESRAEYNITITVTDLGTPRLKTEYNITLRVSDVNDNAPAFTQTSYTLFVRENNSPALHIGSVSATDRDSGTNAQVTYSLLPPQNPHLPLASLVSINTDNGHLFALRSLDYEALQEFEFRVGASDRGSPALSSEALVRVLVLLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTRTLSQNYQYEVYLAESSESQLKFLKPVLPNFLGEGTGGDSEANSNSRNHFGFN

SEQ ID NO: 873291 - protein, 131 aa, Homo sapiens
CWRFRCIFLQCAILLDISVFVDEQDMLNAYFGLVYPCTYLRKQVLSGILSIEQHYPPLSPDVTTEGRSECLISDFFLCIYTHTTHAHTHTKYQYKHLPSAFLHCHASWSSPPHSVSCSACTPLIRFRCISH

SEQ ID NO: 873292 - protein, 397 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 873293 - protein, 168 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTE

SEQ ID NO: 873294 - protein, 168 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTG

SEQ ID NO: 873295 - protein, 343 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTAPAPRHQPHLSGDLAWGRRDHEQDHPTQCVLSPCLSVPDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIV

SEQ ID NO: 873296 - protein, 490 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 873297 - protein, 490 aa, Homo sapiens; identical to SEQ ID NO: 873296

SEQ ID NO: 873298 - protein, 398 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIV

SEQ ID NO: 873299 - protein, 245 aa, Homo sapiens
AVPERRTLRNRRSLAALAPPTPDMLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 873300 - protein, 70 aa, Homo sapiens
VHQAVPCGRWSPWRMEAPGTLTVPTHPLGRAEVFPHRTACQWASGKHLSHHEEYEALGGCPADQEHRGLP

SEQ ID NO: 873301 - protein, 742 aa, Homo sapiens
PLSPSLNPPIGGEDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILAKIQQGSVSGIGTVNTSATSNQDILTNTEIPLQLVTVSGNETME

SEQ ID NO: 873302 - protein, 560 aa, Homo sapiens
MTAPEKPVKQEEMAALDVDSGGGGGGGGGHGEYLQQQQQHGNGAVAAAAAAQDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILAKIQQGSVSGIGTVNTSATSNQDILTNTEIPLQLVTVSGNETME

SEQ ID NO: 873303 - protein, 633 aa, Homo sapiens
LEDPGNILRSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILAKIQQGSVSGIGTVNTSATSNQDILTNTEIPLQLVTVSGNETME

SEQ ID NO: 873304 - protein, 781 aa, Homo sapiens
MTAPEKPVKQEEMAALDVDSGGGGGGGGGHGEYLQQQQQHGNGAVAAAAAAQDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILAKIQQGSVSGIGTVNTSATSNQDILTNTEIPLQLVTVSGNETME

SEQ ID NO: 873305 - protein, 496 aa, Homo sapiens [sequence omitted]

SEQ ID NO: 873306 - protein, 496 aa, Homo sapiens [sequence omitted]

SEQ ID NO: 873307 - protein, 126 aa, Homo sapiens
TWRSVPRARERKREIASGGPMCWPRGPRRADSGPCCRPFLRCKGPGSDPGAALLPPAREQRRGREGASRGSPARCGQGWQPPPRPRAGSLVFVTSRYPVTRWVLACGGSFPCEARDSARSVRGPGS

SEQ ID NO: 873308 - protein, 126 aa, Homo sapiens; identical to SEQ ID NO: 873307

SEQ ID NO: 873309 - protein, 104 aa, Homo sapiens
CPRKACGQREKHLFLYVSFYLRNQFDQHPSPRLPRRNARIPSPSPIPPWLTKPTRIHSFAWKWVQASHEEHEDALCYGLHYVPCPRDRMLSPNPSIAEREFIRR

SEQ ID NO: 873310 - protein, 121 aa, Homo sapiens
MRTLCLSVRNHFVPMTQFSSHSGSVLHCQNRPASRHTYQPVVPSTAQYAASRQRAWMSWQPTPKPKLLPACWEGEPLPGEPSRGNRRREGGLLLPRSSALRLQEDPQRPWAAELWTARLEL

SEQ ID NO: 873311 - protein, 216 aa, Homo sapiens
ESRQAAAEMEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873312 - protein, 221 aa, Homo sapiens
ESRQAAAEMEDLLDLDEELRYSLATSRAKMGRRAQQESAQAENHLNGKNSSLTLTGETSSAKLPRCRQGGWAGDSVKASNGTQTGKQQLDLNACYHKTHHRNLGLASLEEADIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873313 - protein, 216 aa, Homo sapiens; identical to SEQ ID NO: 873311

SEQ ID NO: 873314 - protein, 138 aa, Homo sapiens
MDQIMRRYTIGTHSLKITDNRKTENSGSDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873315 - protein, 121 aa, Homo sapiens
ESRQAAAEMEDLLDLDEELRYSLATSRAKMGRRAQQESAQAENHLNGKNSSLTLTGETSSAKLPRCRQGGWAGDSVKASKFRRKASEEIEEYVSSILILMVSYVDLGQQCSLGGHDLFHLC

SEQ ID NO: 873316 - protein, 91 aa, Homo sapiens
ESRQAAAEMEDLLDLDEELRYSLATSRAKMGRRAQQESAQAENHLNGKNSSLTLTGETSSAKLPRCRQGGWAGDSVKASNPVLLLDSHLPA

SEQ ID NO: 873317 - protein, 187 aa, Homo sapiens
MGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873318 - protein, 187 aa, Homo sapiens; identical to SEQ ID NO: 873317

SEQ ID NO: 873319 - protein, 153 aa, Homo sapiens
MRLVGSQKPCLFFFFFRFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873320 - protein, 216 aa, Homo sapiens; identical to SEQ ID NO: 873311

SEQ ID NO: 873321 - protein, 131 aa, Homo sapiens
ESRQAAAEMEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPR

SEQ ID NO: 873322 - protein, 131 aa, Homo sapiens; identical to SEQ ID NO: 873321

SEQ ID NO: 873323 - protein, 216 aa, Homo sapiens; identical to SEQ ID NO: 873311

SEQ ID NO: 873324 - protein, 114 aa, Homo sapiens
ESRQAAAEMEDLLDLDEELRYSLATSRAKMGRRAQQESAQAENHLNGKNSSLTLTGETSSAKLPRCRQGGWAGDSVKASKYSYHSGSGGSTGRRLCFAGGSPSQHPDKAGDDLP

SEQ ID NO: 873325 - protein, 187 aa, Homo sapiens; identical to SEQ ID NO: 873317

SEQ ID NO: 873326 - protein, 268 aa, Homo sapiens
RHVRRPRRWRICSTWTRSFATAWLPPAPSANFPRTDRSQGDRGAPAGVALAPILEFFLWDTSSQKFLQKPHCFMHGRERAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 873327 - protein, 169 aa, Homo sapiens
RHVRRPRRWRICSTWTRSFATAWLPPAPSANFPRTDRSQGDRGAPAGVALAPILEFFLWDTSSQKFLQKPHCFMHGRERAKMGRRAQQESAQAENHLNGKNSSLTLTGETSSAKLPRCRQGGWAGDSVKASKFRRKASEEIEDFRLRPQSLNGSDYGGAVPKQANNSWI

SEQ ID NO: 873328 - protein, 193 aa, Homo sapiens
ESRQAAAEMEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREVQWWQQFPGLSALAFP

SEQ ID NO: 873329 - protein, 89 aa, Homo sapiens
ESRQAAAEMEDLLDLDEELRYSLATSRAKMGRRAQQESAQAENHLNGKNSSLTLTGETSSAKLPRCRQGGWAGDSVKASNRKEPGISMA

SEQ ID NO: 873330 - protein, 222 aa, Homo sapiens
ESRQAAAEMEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVRERNPSWQDDVGWDWDHLFTEVSSEVLTEWDPLQTEKEDPAGQARHT

SEQ ID NO: 873331 - protein, 1227 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 873332 - protein, 948 aa, Homo sapiens
SCVLCCVVFLELYGFDVLIDSTLKPWLLEVNLSPSLACDAPLGPKGLKASYDFQDYGVTLLGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 873333 - protein, 778 aa, Homo sapiens
MNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 873334 - protein, 1227 aa, Homo sapiens; identical to SEQ ID NO: 873331

SEQ ID NO: 873335 - protein, 1227 aa, Homo sapiens; identical to SEQ ID NO: 873331

SEQ ID NO: 873336 - protein, 1242 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTECCQKILPGLPRSVGKALGTNL

SEQ ID NO: 873337 - protein, 1242 aa, Homo sapiens; identical to SEQ ID NO: 873336

SEQ ID NO: 873338 - protein, 1104 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRYVKGPATSIWVTQGWPVSQASHSHLEFCMEIALRHMPFLHLPRSSLAPD

SEQ ID NO: 873339 - protein, 1222 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDD

SEQ ID NO: 873340 - protein, 122 aa, Homo sapiens [sequence omitted]

SEQ ID NO: 873341 - protein, 94 aa, Homo sapiens
RKQIFWVDGTWQWGHSADALYTPSEHTCCPSESLHWLIGNHLTANADFHWDNKKADLLGFDGTWQWGHSADALYTPSEHTCIFYLPFAPCPQTA

SEQ ID NO: 873342 - protein, 1225 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 873343 - protein, 1227 aa, Homo sapiens; identical to SEQ ID NO: 873331

SEQ ID NO: 873344 - protein, 1227 aa, Homo sapiens; identical to SEQ ID NO: 873331

SEQ ID NO: 873345 - protein, 1222 aa, Homo sapiens; identical to SEQ ID NO: 873339

SEQ ID NO: 873346 - protein, 167 aa, Homo sapiens
MGRAHLNKGGEGVLIPDACGPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 873347 - protein, 942 aa, Homo sapiens
FCFSLERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGE

SEQ ID NO: 873348 - protein, 121 aa, Homo sapiens
MKEYVLLLFLALCSAKPFFSPSHIALKNMMLKDMEDTDDDDDDDDDDLSQGYDSSERDFSLIDDPMMPANSDSSEDADDWSPSMGPHCLGRLLLFSFTLGPWYGKRGEGAEMWGEVPGIPR

SEQ ID NO: 873349 - protein, 380 aa, Homo sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 873350 - protein, 243 aa, Homo sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKDNLPSF

SEQ ID NO: 873351 - protein, 380 aa, Homo sapiens; identical to SEQ ID NO: 873349

SEQ ID NO: 873352 - protein, 111 aa, Homo sapiens
MVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873353 - protein, 107 aa, Homo sapiens
MGAYLSQPNTVKCSGDGVGAPRLPLPYGFSAMQGWRVSMEIAGATKRKTEHKHKNTNQQTTTHKNTNKKQKKTPQTTHTTTTTTPTHTQQNHQTHNTKTTTTNTNKT

SEQ ID NO: 873354 - protein, 423 aa, Homo sapiens
MKMKKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873355 - protein, 423 aa, Homo sapiens; identical to SEQ ID NO: 873354

SEQ ID NO: 873356 - protein, 414 aa, Homo sapiens
MKMKKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873357 - protein, 423 aa, Homo sapiens; identical to SEQ ID NO: 873354

SEQ ID NO: 873358 - protein, 423 aa, Homo sapiens; identical to SEQ ID NO: 873354

SEQ ID NO: 873359 - protein, 468 aa, Homo sapiens
AVVNRPRKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873360 - protein, 595 aa, Homo sapiens
RILNEIILPPPRFRSLTAPVPLPPPGRPRAFHRHLASVAPRGLLLPRAPPGLRLRHGSRPAFLHLRPPASRRHGCLPLPAQHGEVLRGRGRRPAPAAALRLLRHARLARLHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873361 - protein, 458 aa, Homo sapiens
MGSMALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873362 - protein, 356 aa, Homo sapiens
MKMKKEKVADEDDVDNEEAALLHEEATMTIEELLTRYGQNCHKGPPHSKSGASASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873363 - protein, 423 aa, Homo sapiens; identical to SEQ ID NO: 873354

SEQ ID NO: 873364 - protein, 328 aa, Homo sapiens
MKMKKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWKCEPPEL

SEQ ID NO: 873365 - protein, 365 aa, Homo sapiens
MKMKKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWDVISSQEVVTLLPTKNIHRSDNGDSGQWHPGGRAWHMSVHNFAC

SEQ ID NO: 873366 - protein, 521 aa, Homo sapiens
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873367 - protein, 316 aa, Homo sapiens
MGRQDLRTQLGTSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873368 - protein, 287 aa, Homo sapiens
MGAYLSQPNTVKCSGDGVGAPRLPLPYGFSAMQGWRVSMEALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSLKCSGDGVGAPRLPLPYGFFRHARLCALLHGTDAHNCIPELDSETAMFSVYDGHGGEEVALYCAKYLPDIIKDQKAYKEGKLQKALEDAFLAIDAKLTTEEVIKELAQIAGRPTEDEDEKRKSS

SEQ ID NO: 873369 - protein, 283 aa, Homo sapiens
MVEAVLKEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873370 - protein, 319 aa, Homo sapiens
CHPQTPSLVSFSVLRTCVQSGPLDSEYELWGEEGIIPVSAVWDPPPGRECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873371 - protein, 333 aa, Homo sapiens
EEKKKQLVRQVREMEAELEDERKQRSMAVTARKKLEMDLKDLEAHIDSANKNRDEAIKQLRKLQAQMKDCMRELDDTRASREEILAQAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873372 - protein, 169 aa, Homo sapiens
SSTETLPSMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873373 - protein, 149 aa, Homo sapiens
RSHGSCRFHSIKDLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873374 - protein, 410 aa, Homo sapiens
AVVNRPRKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWDVISSQEVVTLLPTKNIHRSDNGDSGQWHPGGRAWHMSVHNFAC

SEQ ID NO: 873375 - protein, 222 aa, Homo sapiens
RILNEIILPPPRFRSLTAPVPLPPPGRPRAFHRHLASVAPRGLLLPRAPPGLRLRHGSRPAFLHLRPPASRRHGCLPLPAQHGEVLRGRGRRPAPAAALRLLRHARLARLHGGEEVALYCAKYLPDIIKDQKAYKEGKLQKALEDAFLAIDAKLTTEEVIKELAQIAGRPTEDEDEKEKVADEDDERQEEEGQARLAVIQTPAHLDCFLSPPDLRLSFVFFL

SEQ ID NO: 873376 - protein, 370 aa, Homo sapiens
MGAYLSQPNTVKCSGDGVGAPRLPLPYGFSAMQGWRVSMEALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSLKCSGDGVGAPRLPLPYGFFRHARLCALLHGTDAHNCIPELDSETAMFSVYDGHGGEEVALYCAKYLPDIIKDQKAYKEGKLQKALEDAFLAIDAKLTTEEVIKELCCPSQPPLLLGLITGSVPVLCCVGGKDWRFWFLLCELYLRTFFFIGGSMALGRLHPLSVVHFQSTLFQTKGQNLIVRIVSFFFCCRGPRLGPICSMWRAPM

SEQ ID NO: 873377 - protein, 298 aa, Homo sapiens
RILNEIILPPPRFRSLTAPVPLPPPGRPRAFHRHLASVAPRGLLLPRAPPGLRLRHGSRPAFLHLRPPASRRHGCLPLPAQHGEVLRGRGRRPAPAAALRLLRHARLARLHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLP

SEQ ID NO: 873378 - protein, 343 aa, Homo sapiens
MGAYLSQPNTVKCSGDGVGAPRLPLPYGFSAMQGWRVSMEALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSLKCSGDGVGAPRLPLPYGFFRHARLCALLHGTDAHNCIPELDSETAMFSVYDGHGGEEVALYCAKYLPDIIKDQKAYKEGKLQKALEDAFLAIDAKLTTEEVIKELCCPSQPPLLLGLITGSVPVLCCVGGKDWRFWFLLCELYLRTFFFIGGSMALGRLHPLSVVHFQSTLFQTKGQNL

SEQ ID NO: 873379 - protein, 120 aa, Homo sapiens
MPYGLAGGPLCDTSCPFLSYHPDSASQPSCGTVDSWQGVQTLWLSYPHPFLELLDQCLAPDTSGDGTGCDNMTCIIICFKPRNTAELQPESGKRKLEEVLSTEGAEENGNSDKKKKAKRD

SEQ ID NO: 873380 - protein, 123 aa, Homo sapiens
MGAYLSQPNTVKCSGDGVGAPRLPLPYGFSAMQGWRVSMEDAHNCIPELDSETAMFSVYDGHGGTLTDHIGNILGPQFQTFQGKNRSLCSFTFQGLALIIISCVVLFFCILSFFFPSRYCIGL

SEQ ID NO: 873381 - protein, 423 aa, Homo sapiens; identical to SEQ ID NO: 873354

SEQ ID NO: 873382 - protein, 423 aa, Homo sapiens; identical to SEQ ID NO: 873354

SEQ ID NO: 873383 - protein, 423 aa, Homo sapiens; identical to SEQ ID NO: 873354

SEQ ID NO: 873384 - protein, 423 aa, Homo sapiens; identical to SEQ ID NO: 873354

SEQ ID NO: 873385 - protein, 423 aa, Homo sapiens; identical to SEQ ID NO: 873354

SEQ ID NO: 873386 - protein, 494 aa, Homo sapiens
MGAYLSQPNTVKCSGDGVGAPRLPLPYGFSAMQGWRVSMEALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873387 - protein, 132 aa, Homo sapiens
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKRKSS

SEQ ID NO: 873388 - protein, 342 aa, Homo sapiens
QASQAGVNRPRPNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873389 - protein, 132 aa, Homo sapiens; identical to SEQ ID NO: 873387

SEQ ID NO: 873390 - protein, 330 aa, Homo sapiens
MLGRAWLIGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873391 - protein, 288 aa, Homo sapiens
NLRLGARLGGEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873392 - protein, 165 aa, Homo sapiens
MKMKKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSENAARKGQHARKAR

SEQ ID NO: 873393 - protein, 132 aa, Homo sapiens; identical to SEQ ID NO: 873387

SEQ ID NO: 873394 - protein, 147 aa, Homo sapiens
MGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 873395 - protein, 132 aa, Homo sapiens; identical to SEQ ID NO: 873387

SEQ ID NO: 873396 - protein, 334 aa, Homo sapiens
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKQVENLQPEIKTIARHLNQEVAVRANQLGWSKRDARLTYLKNMRRLISELYVRDNCHPFKATVLVWIQLPMWIFMSFALRNLSTGAAHSEGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 873397 - protein, 334 aa, Homo sapiens; identical to SEQ ID NO: 873396

SEQ ID NO: 873398 - protein, 334 aa, Homo sapiens; identical to SEQ ID NO: 873396

SEQ ID NO: 873399 - protein, 334 aa, Homo sapiens; identical to SEQ ID NO: 873396

SEQ ID NO: 873400 - protein, 334 aa, Homo sapiens; identical to SEQ ID NO: 873396

SEQ ID NO: 873401 - protein, 334 aa, Homo sapiens; identical to SEQ ID NO: 873396

SEQ ID NO: 873402 - protein, 334 aa, Homo sapiens; identical to SEQ ID NO: 873396

SEQ ID NO: 873403 - protein, 303 aa, Homo sapiens
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKQVENLQPEIKTIARHLNQEVAVRANQLGWSKRDARLTYLKNMRRLISELYVRDNCHPFKATVLVWIQLPMWIFMSFALRNLSTGAAHSEGFSVQEQLATGGILWFPDLTAPDSTWILPISVGVINLLIVEICALQKIGMSRFQTYITYFVRAMSVLMIPIAATVPSSIVLYWLCSSFVGLSQNLPKVLGLQA

SEQ ID NO: 873404 - protein, 106 aa, Homo sapiens
LAGTTLLIFPPLQICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 873405 - protein, 100 aa, Homo sapiens
LAKVADGDAQSATLNFLQAAAAHCTNWDLQQGLLRVCRALLRAGVRGGLVDLLQVLARQLEDPDGRDHARLYYILLAHLAAPKLGVALGPSLAAPALASS

SEQ ID NO: 873406 - protein, 244 aa, Homo sapiens
LGESVVNGRGVAENQGFVAALMVQEAPALVRLSLGSHRVKGPLPVLKLQPEALEPIYSLELRFRVEGQLYAPLEAVHVPCLCPGRPARPLLLPLQPRCPAPARLDVHALYTTSTGLTCHAHLPPLFVNFADLFLPFPQPPEGAGLGFFEELWDSCLPEGAESRVWCPLGPQGLEGLVSRHLEPFVVVAQPPTSYCVAIHLPPDSKLLLRLEAALADGVPVALRTDDWAVLPLAGDYLRGLAAAV

SEQ ID NO: 873407 - protein, 464 aa, Homo sapiens
ATSLLDTLVLLPPRVAIWGEALSPPREQRPLQATACECLRELESCKPGLLGGSLGLLRGLLGQEGPVQPLSLLLALALRNTLVLQSRVGAGLGGLLTDKVSPTGGGPWDWTLVEEGDGRLQPQAPSWPAAEEGEGERSLTAREHSPEEARELRAAVIQLLDTSYLLTPVAQAQLLWLLGWALRGLQGQPPALFKPQLVRLLGTAQLTLLHAMLALKAAFGEALFTAQDEALLLRRLTLAAQHPALPPPTHLFYLHCVLSFPENWPLGPEGEEAAPLLLGPQLCRGLLPSLLHDPMALLARLHLLCLLCAEEEEEEKGQLPSPRHYLEELLAGLRQRAALDGGPRALATLCFQASYLVACCLAGQPTVLTPLIHGLAQLYQARPMLAPHFVDLLDQVDSELREPLKVVAQPPTSYCVAIHLPPDSKLLLRLEAALADGVPVALRTDDWAVLPLAGDYLRGLAAAV

SEQ ID NO: 873408 - protein, 1064 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGESRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873409 - protein, 158 aa, Homo sapiens
PLPFTPWDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873410 - protein, 899 aa, Homo sapiens
MCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGESRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873411 - protein, 314 aa, Homo sapiens
MKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873412 - protein, 978 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGESRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKTTVQTGSEEEEEEEGEPEDTELGDEMTECLTMPAQKRACPRPCQKRGLFPQRSGVEGTSHSHPFR

SEQ ID NO: 873413 - protein, 435 aa, Homo sapiens
ERRPHTWSRCCHAFFHLGPGWGHSLWCKKAVRFSWICGIHYTTPQRKLVLLDCLLFLDLPSFFFFSSSSAWKKTSHMEQVFAMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873414 - protein, 1094 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGESRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 873415 - protein, 1094 aa, Homo sapiens; identical to SEQ ID NO: 873414

SEQ ID NO: 873416 - protein, 1094 aa, Homo sapiens; identical to SEQ ID NO: 873414

SEQ ID NO: 873417 - protein, 916 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGESRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKVIY

SEQ ID NO: 873418 - protein, 158 aa, Homo sapiens; identical to SEQ ID NO: 873409

SEQ ID NO: 873419 - protein, 404 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKRRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVITHRLSGIL

SEQ ID NO: 873420 - protein, 570 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873421 - protein, 534 aa, Homo sapiens
MEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873422 - protein, 352 aa, Homo sapiens
MFLLTPGDFFLQLEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873423 - protein, 510 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873424 - protein, 134 aa, Homo sapiens
MELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873425 - protein, 570 aa, Homo sapiens; identical to SEQ ID NO: 873420

SEQ ID NO: 873426 - protein, 570 aa, Homo sapiens; identical to SEQ ID NO: 873420

SEQ ID NO: 873427 - protein, 570 aa, Homo sapiens; identical to SEQ ID NO: 873420

SEQ ID NO: 873428 - protein, 123 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEASYCL

SEQ ID NO: 873429 - protein, 570 aa, Homo sapiens; identical to SEQ ID NO: 873420

SEQ ID NO: 873430 - protein, 570 aa, Homo sapiens; identical to SEQ ID NO: 873420

SEQ ID NO: 873431 - protein, 570 aa, Homo sapiens; identical to SEQ ID NO: 873420

SEQ ID NO: 873432 - protein, 570 aa, Homo sapiens; identical to SEQ ID NO: 873420

SEQ ID NO: 873433 - protein, 570 aa, Homo sapiens; identical to SEQ ID NO: 873420

SEQ ID NO: 873434 - protein, 570 aa, Homo sapiens; identical to SEQ ID NO: 873420

SEQ ID NO: 873435 - protein, 321 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGMYLRVSHQCQPRVDGTIMGRPGRGIGNSTRSANIRNTLWPGEGDGSRPKR

SEQ ID NO: 873436 - protein, 570 aa, Homo sapiens; identical to SEQ ID NO: 873420

SEQ ID NO: 873437 - protein, 684 aa, Homo sapiens
MASGRRGWDSSHEDDLPVYLARPGTTDQVPRQKYGGMFCNVEGAFESKTLDFDALSVGQRGAKTPRSGQGSDRGSGSRPGIEGDTPRRGQGREESREPAPASPAPAGVEIRSATGKEVLQNLGPKDKSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873438 - protein, 511 aa, Homo sapiens
MYEAVPGCYFMQGRGLDVIIHGPERRQYDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873439 - protein, 275 aa, Homo sapiens
LTVNTRLQAPSVPPAISPVHVELFSFASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 873440 - protein, 570 aa, Homo sapiens; identical to SEQ ID NO: 873420

SEQ ID NO: 873441 - protein, 570 aa, Homo sapiens; identical to SEQ ID NO: 873420

SEQ ID NO: 873442 - protein, 570 aa, Homo sapiens; identical to SEQ ID NO: 873420

SEQ ID NO: 873443 - protein, 570 aa, Homo sapiens; identical to SEQ ID NO: 873420

SEQ ID NO: 873444 - protein, 570 aa, Homo sapiens; identical to SEQ ID NO: 873420

SEQ ID NO: 873445 - protein, 570 aa, Homo sapiens; identical to SEQ ID NO: 873420

SEQ ID NO: 873446 - protein, 570 aa, Homo sapiens; identical to SEQ ID NO: 873420

SEQ ID NO: 873447 - protein, 206 aa, Homo sapiens
MSYQGKKNIPRITSDRLLIKGGRIVNDDQSFYADIYMEDGLIKIETSIFWGVFFPPGEELKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELAVSRDRATALQPGRQSETPS

SEQ ID NO: 873448 - protein, 80 aa, Homo sapiens
MLFPKSTLLAFPSAAVGPGSPCVPSTHDGQMLVQDEQLRKRLPGQVQWLTPVIPALWEAEVGGSRGQEFKTSLRKMEKPC

SEQ ID NO: 873449 - protein, 136 aa, Homo sapiens
CQTPRHFFSAPNPPCRAQLLILALGLEDHMAPAQGLNVQQWAQALPPRWSGVDWHVRVPHRFSWGLGTATNPHLELLHSLTAAMDSQSCQIRPLLWVSKPPTPTFLDSAPFHTDDLSLSFLFQQLTFFSFVNDSVY

SEQ ID NO: 873450 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 873451 - protein, 174 aa, Homo sapiens
MAGTWLLLLLALGCPALPTGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 873452 - protein, 256 aa, Homo sapiens
MAGTWLLLLLALGCPALPTGPVSFPSSPEAATTGPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 873453 - protein, 118 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHTV

SEQ ID NO: 873454 - protein, 103 aa, Homo sapiens
FYFLRWSLALSPSLECSGLISAHCNLCLLDSSDSPASASQVAGTTGMCHHAWQIFVLLVETGFHRVGQAGLELLNSGDPPASASHSAGITGVSHHTPCLAFQG

SEQ ID NO: 873455 - protein, 106 aa, Homo sapiens
MPVPQPLFLVQLSCSPGPAPALGSFSYGQPRSRLLPYLSVYLQWPAQLLAQRACSVNVGELNKVQLTNAVASSPLATFLLELSCTFSASSFPPGLPTSLLTRPHFL

SEQ ID NO: 873456 - protein, 248 aa, Homo sapiens
IRSCEEAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 873457 - protein, 306 aa, Homo sapiens
AGAAQLTESLVLARSPRQPRAQPISAPDCTRAMVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 873458 - protein, 306 aa, Homo sapiens; identical to SEQ ID NO: 873457

SEQ ID NO: 873459 - protein, 306 aa, Homo sapiens; identical to SEQ ID NO: 873457

SEQ ID NO: 873460 - protein, 241 aa, Homo sapiens
TLRAQLLRVQVSDSSPLLPGAVTRALCAPHSCLGQGRGPASRAQLPGAPSAHPPVHFACGISPLLLPLDCVAGHPTNTRTLDISGVKTTLRRFSVILQDLCSILVILSSISLHRYHSKPVLCAPSSRASPSSATTLSTRTLWGPGAGSHPFGVHNTRLSPDLCPGKIVLRALKESGAGMPEQHKDPRVQENPDDQRTVPEVTGDARSAFWPLRDNGGPSPFVPRPGPLQTDLHAQSSEIRY

SEQ ID NO: 873461 - protein, 135 aa, Homo sapiens
MSWERLGSGASCMESTRRVPLLSQEVFMERAALPGTAAFSGDQRQARQMCPVSRELPSLVGETSRRSRHRWSGQAQVCAGAPAGMARKASWKNSLSGILWGRVGVSQAEEGKEEGEAEARQQESEIGLRVAAVSS

SEQ ID NO: 873462 - protein, 79 aa, Homo sapiens
SPVLSVSNRQPTRPACTQVARLAGQLSQSHLRRCARKSRSSAVGNDGSHCASTSTGCSLRIGGGGHMLWSPSTACGWRE

SEQ ID NO: 873463 - protein, 319 aa, Homo sapiens
MRSCFCVRRSRDPPPPQPPPPPPQRGTDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 873464 - protein, 319 aa, Homo sapiens; identical to SEQ ID NO: 873463

SEQ ID NO: 873465 - protein, 269 aa, Homo sapiens
HASGPTRPRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 873466 - protein, 304 aa, Homo sapiens
MDTGLSSQPSEEDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 873467 - protein, 304 aa, Homo sapiens; identical to SEQ ID NO: 873466

SEQ ID NO: 873468 - protein, 304 aa, Homo sapiens; identical to SEQ ID NO: 873466

SEQ ID NO: 873469 - protein, 322 aa, Homo sapiens
MDTGLSSQPSEEDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISALPRSPPWQLLSSSAGSCEHHSLLYTLSYASQGPPPAHPLLWAQALLSEFPCPGNECPLRDHTYAASPALLRAVLCQIITLLLKS

SEQ ID NO: 873470 - protein, 107 aa, Homo sapiens
MDLSPSRLEVGEQHPCPRWRGCCFLGRRTVDGPAWIHHQDAVLGHGAPPPRAHLCNNHMPTIAPGASAPCPDPGTTGTPSETCWPQEDTGTRAPSPSQSQACLDGIC

SEQ ID NO: 873471 - protein, 304 aa, Homo sapiens; identical to SEQ ID NO: 873466

SEQ ID NO: 873472 - protein, 249 aa, Homo sapiens
RGYTLGEVPRNHDSSQPTTPSQSSAASTPAPDVSRHISLTLPATFRGRNSTRTDYEYQHSNLYAISEEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 873473 - protein, 304 aa, Homo sapiens; identical to SEQ ID NO: 873466

SEQ ID NO: 873474 - protein, 304 aa, Homo sapiens; identical to SEQ ID NO: 873466

SEQ ID NO: 873475 - protein, 219 aa, Homo sapiens
TAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVVEGWAGGAGIKGLLEDGKEDSSAWGRCSHYNPGTCGG

SEQ ID NO: 873476 - protein, 205 aa, Homo sapiens
MAKRRAAEPVTFHVPWKRLLLCDFAEQPPPPPLWIRPPGVAHAGQLLGVPEQHRKRKIDAGTMAEPSASPSKRRDSGDNSAPSGQEREDHGLETGDPPLPPPPVLPGPGEELPGARLPARPALPARGPPPPSAPPAACPLRNTFWLPFPPIPLPLPDPHHTLPPPLPTPPGPVHIASSSPNPSASLSPPPLLNSRILKGKVIFHT

SEQ ID NO: 873477 - protein, 181 aa, Homo sapiens
MAKRRAAEPVTFHVPWKRLLLCDFAEQPPPPPLWIRPPGVAHAGQLLGVPEQHRKRKIDAGTMAEPSASPSKRRDSGDNSAPSGQEREDHGLETGDPPLPPPPVLPGPGEELPGARLPGGGGDDGAGRAGPPRGDWGVASRQHNEEFWAVLIPNTWKEILLAFLIGSWARHLEEFGGKTTP

SEQ ID NO: 873478 - protein, 194 aa, Homo sapiens
MAKRRAAEPVTFHVPWKRLLLCDFAEQPPPPPLWIRPPGVAHAGQLLGVPEQHRKRKIDAGTMAEPSASPSKRRDSGDNSAPSGQEREDHGLETGDPPLPPPPVLPGPGEELPGARLPGGGGDDGAGRAGPPRGDWGVASRQHNEEFWQYNTFQYWRNPLPPIDLADIEDLSEDTLTEATLQGRNEGAEVDMES

SEQ ID NO: 873479 - protein, 82 aa, Homo sapiens
WNRNGREIVALAEEPYSEQHRKRKIDAGTMAEPSASPSKRRDSGDNSAPSGQEREDHGLETRRVHAHAESHTLLQGGSSKSR

SEQ ID NO: 873480 - protein, 72 aa, Homo sapiens
WISAPLGLRGFPSTACQVWIQHMQVTAVKAGHVPATGAGRWGLRCERDSLGSCSAHRPWEEHSAGQWEELQL

SEQ ID NO: 873481 - protein, 139 aa, Homo sapiens
MVISAQCSECQSKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 873482 - protein, 319 aa, Homo sapiens
MVLSELAARLNCAEYKNWVKAGHCLLLLRSCLQGFVGREVLSFHRGLLAAAPGLGPRAVCRGGSRCSPRARQFQPQCQVCAEWKREILRHHVNRNGDVHWGNCRPGRWPVDAWEVAKAFMPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 873483 - protein, 319 aa, Homo sapiens; identical to SEQ ID NO: 873482

SEQ ID NO: 873484 - protein, 221 aa, Homo sapiens
MAHCSNSAGSIHPPPQPLAAFMPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 873485 - protein, 572 aa, Homo sapiens
RRPSFPFPLSPPPEARGAGSPFRAAGVRQRRAWGCGGRGSQVRGARAAPGSLLAGRPPRSFPFASVSPLRSPGGGEYSGYIFAIMDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSVIIPQSYITVLSTGQKEPTKGLREENLALLKRFEAVKPTVGMESSEQMMDYYLNMGYLNSSPLSRRQIILGISH

SEQ ID NO: 873486 - protein, 443 aa, Homo sapiens
SLESKQSQKIENDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRTEGTNQRI

SEQ ID NO: 873487 - protein, 483 aa, Homo sapiens
HAAPPFPFRSLRLRKRGAPGARSGPRECASAARGAVVAAALRYIFAIMDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRTEGTNQRI

SEQ ID NO: 873488 - protein, 529 aa, Homo sapiens
WKILLQVSAALVIPELSNPDGYHYLHLHSGELKHRRYIFAIMDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSVIIPQSYITVLSTGQKEPTKGLREENLALLKRFEAVKPTVGMESSEQMMDYYLNMGYLNSSPLSRRQIILGISH

SEQ ID NO: 873489 - protein, 445 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 873490 - protein, 479 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLRACTRRVLLRPEKRPPVSVWVLQSPDHHNWLADKMLTTVEKKVMIHD

SEQ ID NO: 873491 - protein, 109 aa, Homo sapiens
MKGCGGGKENVQLEMSGQWQDQPQGWKRGCKEGRGDGETKLQVGSEVGVRPDLKGHCRLRLSSPFASTESLLLASCLSLAHRPLFLQSVGDLPSQTPCFLLQTLLISLC

SEQ ID NO: 873492 - protein, 672 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYG

SEQ ID NO: 873493 - protein, 189 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQVAVICIFLIFYIM

SEQ ID NO: 873494 - protein, 730 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGNQDFIFHKSTMCFNSDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 873495 - protein, 715 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 873496 - protein, 715 aa, Homo sapiens; identical to SEQ ID NO: 873495

SEQ ID NO: 873497 - protein, 108 aa, Homo sapiens
RSSHVNSFNHRVVRRAHRQFSQGDAAYGIQVNLLDETCEYVRLGSGCRHTWLIFALLVETGFCHVTQAGLELLTSSDPPASASQSVGITATVPGIHFSFKRDFCSYDY

SEQ ID NO: 873498 - protein, 187 aa, Homo sapiens
MKLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEATSWRRAGAGADEDTSTPPSRVCDNPWPLGTCCAEEAEFLELRDADERMMSHSQLQTRGRLKQNQPVLQKLKIQSSHNVLSPGPTHERS

SEQ ID NO: 873499 - protein, 76 aa, Homo sapiens
LWTRGIISAGAPDTRSGPSPTLQQPPLLTLSPSAQSLRCSSSIFSVGIAGTNGTGWGGEFGTKNTHEPLEATIEVR

SEQ ID NO: 873500 - protein, 591 aa, Homo sapiens
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWER

SEQ ID NO: 873501 - protein, 741 aa, Homo sapiens
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKINECVMKKMNKFYEKRGNFYQNTVGDLLKFIRNLGEHIDEEKHKKMKLKIGDPSLYFQKTFPDLVIYVYTKLQNTEYRKHFPQTHSPNKPQCDGAGGASGLASPGC

SEQ ID NO: 873502 - protein, 42 aa, Homo sapiens
RRKGEYISIFIYEKEKQAEKMKEKESPNSAPSWSSSRSCFLD

SEQ ID NO: 873503 - protein, 100 aa, Homo sapiens
MPALGVLPQSAPAGCVDPGLKGGASAAGCVDPGLKGGASAARCLDPGLKGGRFGCWMCGPWIERRRFGCWMPGPWSERRRFGCWMCGPWIERRRFGCWMC

SEQ ID NO: 873504 - protein, 102 aa, Homo sapiens
MLTSCEMTKDLAAEGKRKNNGKRIYLTQLEMAPFPYLLLHPEASPMLGSDVNKQRGRMQPLQRHMFEIPGHWRSSRLLYSPQIKNEKRIHNLVIASSESSEL

SEQ ID NO: 873505 - protein, 96 aa, Homo sapiens
MAFSQHTISALVPRITHFSLGPFTFLFSSPGHRLLLKAILSGPGANPLAASSEFLGFPPTLCLPSMGSPGDFLPGFHFLSIPVLFTCSSAGRASSP

SEQ ID NO: 873506 - protein, 219 aa, Homo sapiens
MASMGTLAFDEYGRPFLIIKDQDRKSRLMGLEALKSHIMAAKAVANTMRTSLGPNGLDYSMMVDKDGDVTVTNDGATILSMMDVDHQIAKLMVELSKSQDDEHWRWNHRSGCPGWCLVRNEAEQWLDRGSAPNQNERLAMRQAARVTTEHLDKISDETSLVDIKDTKPLQFRHSKNQSWAPKVDTQRITDQHGMKNGREVPSSTWRHETGGAETKTEET

SEQ ID NO: 873507 - protein, 260 aa, Homo sapiens
MSATGPISNYYVDSLISHDNEDLLASRFPATGAHPAAARPSGLVPDCSDFPSCSFAPKPAVFSTSWAPVPSQSSVVYHPYGPQPHLGADTRYMRTWLEPLSGAVSFPSFPAGGRHYALKPDAYPGRRADCGPGEGRSYPDYMYGSPGELRDRAPQTLPSPEADALAGSKHKEEKADLDPSNPVANWIHARSTRKKRCPYTKYQTLELEKEFLFNMYLTRDRRYEVARVLNLTERQVKIWFQNRRMKMKKMNKEKTDKEQS

SEQ ID NO: 873508 - protein, 260 aa, Homo sapiens; identical to SEQ ID NO: 873507

SEQ ID NO: 873509 - protein, 102 aa, Homo sapiens
MNYLMAYISSQFYYNDKCYRTLTINMLFLRPKGKLNHNTLTVQIASGKTETETQACLITTAAVFTAAGAGKVTKSAQKAQKLDEFIPNTCHPTLNQWWKNGL

SEQ ID NO: 873510 - protein, 137 aa, Homo sapiens
LGPAHVMAPEENAGTELLLQSLERRFLAARALRSFPWQSLEAKLRDSSDSELLRDILQKTCCIAQKPSCRWSGSCGGWLPAGSTSGLLKSMWPLPSATQRRASCSPLSYAGLGSDGKWNLVMTRNCFPTKSTWRWQC

SEQ ID NO: 873511 - protein, 126 aa, Homo sapiens
CRLYGVWDIGLERRFLAARALRSFPWQSLEAKLRDSSDSELLRDILQKTCCIAQKPSCRWSGSCGGWLPAGSTSGLLKSMWPLPSATQRRASCSPLSYAGLGSDGKWNLVMTRNCFPTKSTWRWQC

SEQ ID NO: 873512 - protein, 87 aa, Homo sapiens
LGPAHVMAPEENAGTELLLQSLERRFLAARALRSFPWQSLEAKLRDSSDSELLRDILQKAGLGSDGKWNLVMTRNCFPTKSTWRWQC

SEQ ID NO: 873513 - protein, 119 aa, Homo sapiens
MALVPWQGWGPIKCTSILMPVTRGWFSHLMPGAPLQQKAREGAELLVLQSWPQHAQAGLSGHLLYHPHQWHTGPRVLLCPGVADPFPSLPGEPTHHRQAPDLGGDHPQRPRRSPVELRV

SEQ ID NO: 873514 - protein, 621 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAVFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 873515 - protein, 621 aa, Homo sapiens; identical to SEQ ID NO: 873514

SEQ ID NO: 873516 - protein, 229 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEGGNCRWSLATSLGIRAQVPWKGENIWLLGPYR

SEQ ID NO: 873517 - protein, 621 aa, Homo sapiens; identical to SEQ ID NO: 873514

SEQ ID NO: 873518 - protein, 621 aa, Homo sapiens; identical to SEQ ID NO: 873514

SEQ ID NO: 873519 - protein, 166 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKAPATMPSQFLYF

SEQ ID NO: 873520 - protein, 730 aa, Homo sapiens
LRLDLRRPQPRCSGRPASAGKSAPPLPPPSAARAPRSRRRRRAETPRLRLGAPSRTWRTRPQARSVLDPAGLRSPVLGPVPRAAMSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 873521 - protein, 730 aa, Homo sapiens; identical to SEQ ID NO: 873520

SEQ ID NO: 873522 - protein, 730 aa, Homo sapiens; identical to SEQ ID NO: 873520

SEQ ID NO: 873523 - protein, 432 aa, Homo sapiens
MDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 873524 - protein, 417 aa, Homo sapiens
RSPTPAPPLARRAPAEGEGGTGRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 873525 - protein, 76 aa, Homo sapiens
IMYSDDEEKKHEEMKKALNAEEARLLHVKGDHADLMRGKRPYNSMYETREPTEEELEAYRMKRQRPDDPMASFLGQ

SEQ ID NO: 873526 - protein, 549 aa, Homo sapiens
MSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHESTGHEFMSSAFIPISYTGDEGPDM

SEQ ID NO: 873527 - protein, 76 aa, Homo sapiens; identical to SEQ ID NO: 873525

SEQ ID NO: 873528 - protein, 730 aa, Homo sapiens; identical to SEQ ID NO: 873520

SEQ ID NO: 873529 - protein, 252 aa, Homo sapiens
MSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 873530 - protein, 529 aa, Homo sapiens
MSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQEWYVLLVLNLFREMEINGMKSDRVDYLGYHKCFPKNLQSC

SEQ ID NO: 873531 - protein, 686 aa, Homo sapiens
LRLDLRRPQPRCSGRPASAGKSAPPLPPPSAARAPRSRRRRRAETPRLRLGAPSRTWRTRPQARSVLDPAGLRSPVLGPVPRAAMSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKNSKEAQ

SEQ ID NO: 873532 - protein, 79 aa, Homo sapiens
TRSPTGWPWSDFFRTLIAAILYLITSIVVLVERGNHSKIVAGVLGLIATCLFGYDAYVTFPVRQPRHTAAPTDPADGPV

SEQ ID NO: 873533 - protein, 152 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 873534 - protein, 125 aa, Homo sapiens [sequence omitted]

SEQ ID NO: 873535 - protein, 79 aa, Homo sapiens; identical to SEQ ID NO: 873532

SEQ ID NO: 873536 - protein, 152 aa, Homo sapiens; identical to SEQ ID NO: 873533

SEQ ID NO: 873537 - protein, 152 aa, Homo sapiens; identical to SEQ ID NO: 873533

SEQ ID NO: 873538 - protein, 243 aa, Homo sapiens
AGGPFPDKMAGKIGEGVAAFRRIARASEQMLSEAARWESKVAMPMVGFVMLPSSWFTLALRGCTVVLATFVVGIVEESGEIRPGFGVEDLIVNGAWVDSVKSWHCRFDAHIDLVDIASFTLLRLNLEALDSRLSEAEYIVMWLWLLTEWVGASLGQRTQRMTQVASPSWGAWEWNFFRTLIAAILYLITSIVVLVERGNHSKIVAGVLGLIATCLFGYDAYVTFPVRQPRHTAAPTDPADGPV

SEQ ID NO: 873539 - protein, 92 aa, Homo sapiens
MADSERLSAPGCWAACTNFSRTRKGILLFAEIILCLVILICFSASTPGYSSLSVIEMILAAIFFVVYMCDLHTKIPFINWPWSVRRRPPEQT

SEQ ID NO: 873540 - protein, 112 aa, Homo sapiens
WLGVRGLLRGQREKGKGSLKGTNANSGLVLVLRAFVPIGTISFGILVCKMFMDFGSCFKKWAYRFSQCFLSFPHLQTPQMARCRRTSLISLCNLQITPPLEITSHIPTPTTT

SEQ ID NO: 873541 - protein, 152 aa, Homo sapiens; identical to SEQ ID NO: 873533

SEQ ID NO: 873542 - protein, 152 aa, Homo sapiens; identical to SEQ ID NO: 873533

SEQ ID NO: 873543 - protein, 152 aa, Homo sapiens; identical to SEQ ID NO: 873533

SEQ ID NO: 873544 - protein, 152 aa, Homo sapiens; identical to SEQ ID NO: 873533

SEQ ID NO: 873545 - protein, 152 aa, Homo sapiens; identical to SEQ ID NO: 873533

SEQ ID NO: 873546 - protein, 141 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGYWANRSALVELCTSVGAEESHAEMAV

SEQ ID NO: 873547 - protein, 145 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVKAMGAALKHRAKGLRSQGPFLPLLLAEIV

SEQ ID NO: 873548 - protein, 92 aa, Homo sapiens
VAGADLEDPKLNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873549 - protein, 123 aa, Homo sapiens
KQSLLILDSCAQPFFTCRPDGKLLSSDVTHYVIPDWKVVQDYLEILEFPELKGIIFMQTACQAVQHQRGRRQYNKLRNLLKDARHDCILFANEFQQCCYLPRERGESMEKWQTRKTPGHFTNG

SEQ ID NO: 873550 - protein, 1047 aa, Homo sapiens
VLLLRTFQGRTLRIVREHYLRPCVPCHSPLCPQPAACSHDGKLLSSDVTHYVIPDWKVVQDYLEILEFPELKGIIFMQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873551 - protein, 1088 aa, Homo sapiens
VLLLRTFQGRTLRIVREHYLRPCVPCHSPLCPQPAACSHDGKLLSSDVTHYVIPDWKVVQDYLEILEFPELKGIIFMQTACQAVQHQRGRRDRVSFCSSGWSSVDNHSSLQPQTPGLKGPSCLSLPRSWNYRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873552 - protein, 953 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPRLRASPQVSPCLQVEWWAYFKKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873553 - protein, 912 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873554 - protein, 234 aa, Homo sapiens
MEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873555 - protein, 776 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQVRGNFKILLPVISC

SEQ ID NO: 873556 - protein, 160 aa, Homo sapiens
MEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISGRQSGVP

SEQ ID NO: 873557 - protein, 71 aa, Homo sapiens
KEKALLAGVLIRLRVYHARNASLVCHSLGFMGFFCAAPNTDLVSDILIHGMKARNRSIHGDVVVVELLPRA

SEQ ID NO: 873558 - protein, 971 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873559 - protein, 1004 aa, Homo sapiens
VLLLRTFQGRTLRIVREHYLRPCVPCHSPLCPQPAACSHDGKLLSSDVTHYVIPDWKVVQDYLEILEFPELKGIIFMQTACQAVQHQRGRRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873560 - protein, 910 aa, Homo sapiens
MQTACQAVQHQRGRRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPRLRASPQVSPCLQVEWWAYFKKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 873561 - protein, 765 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLGEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQVEM

SEQ ID NO: 873562 - protein, 119 aa, Homo sapiens
GAFIQRIIQKTPNCKKQCFWQQIKEASFFPSLTCLLRYNIQESTQIFFSLINFCVTTIQIKVQNLFSSPEISMCLFLVISSPPQRKLTSVMKVYPGPSFHPQNFLQRNDPRKPISYNNK

SEQ ID NO: 873563 - protein, 358 aa, Homo sapiens
GAEGSLGAERALHGPCTLELMFRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 873564 - protein, 292 aa, Homo sapiens
GPQSHSVYALLAQGPRSSSFPVAKRRQGCVGQQDAVSRVKLSAHEVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 873565 - protein, 86 aa, Homo sapiens
SRVRLGSQAGLTFAVQSRFSFDRNCAGYHLPLVTHHHLLAGHKAGEELPVPRGPADAALTAVLPQGTRGLCGPHSGDLLAGLGEVA

SEQ ID NO: 873566 - protein, 1225 aa, Homo sapiens
SGGGGDGSLGRARAMLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 873567 - protein, 1191 aa, Homo sapiens
MSFLPVRSVIGGGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 873568 - protein, 1145 aa, Homo sapiens
MSFLPVRSVIGGGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTDPCFGALLEYSITNGVYMGCDLPPALQSLQNCGEGVADPSYPVVPESTGPEKHQEPS

SEQ ID NO: 873569 - protein, 96 aa, Homo sapiens
MEQRGAAHIKGARDYIKPRENGEAAATNQKKRRRRRRAGKNTAERRRGGDITLAAEETSTPPPPGRGEGSTPWCGTTHQAPNEGLEEGPAGGPTTG

SEQ ID NO: 873570 - protein, 132 aa, Homo sapiens
MQECLIQLSSIIFKKRHHLYSGLAEVIRVTSTEETELRDELEHPSSPAFGHQNFRFSGLQTSRLALVAPWVLKVLAASVESYTIGFFGSEAVGVGLSHATSFPGSPACRLPTVRFSLHNHVTEYWHVALLKT

SEQ ID NO: 873571 - protein, 141 aa, Homo sapiens
NLNRFYILRLVFINKKRFTGISLPTMLNSRISLAHLPAMTNKEAAFDNAVEEHVIKEEYKIWKNNTSFPYDLVMTQALEWPSLTAQWLPDVTRPEGKDFSSHRLVPGTHTSVEQNHLVQLPSDDAQLDASHYNSKKGECGG

SEQ ID NO: 873572 - protein, 69 aa, Homo sapiens
PGMHLSGKAQRVKDLSVGPYSTVPMGGMICIEIRLPVGRTEVVAGEVGAPLPGEPVESYAQWGGESPRE

SEQ ID NO: 873573 - protein, 56 aa, Homo sapiens
LATFGLELKCWLFLGLKPDQPLNGNSTLSSPGSPACRLTLQILGLARLHNYTSQFL

SEQ ID NO: 873574 - protein, 31 aa, Homo sapiens
MVVAAIQGFARRGLMGRLSASCSQEEVTSQA

SEQ ID NO: 873575 - protein, 252 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGGHPNKGYRTFLMR

SEQ ID NO: 873576 - protein, 589 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873577 - protein, 589 aa, Homo sapiens; identical to SEQ ID NO: 873576

SEQ ID NO: 873578 - protein, 490 aa, Homo sapiens
MPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873579 - protein, 490 aa, Homo sapiens; identical to SEQ ID NO: 873578

SEQ ID NO: 873580 - protein, 564 aa, Homo sapiens
ISSPGRHPGTIRSTSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873581 - protein, 392 aa, Homo sapiens
MNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873582 - protein, 449 aa, Homo sapiens
KRNDIYNYHGYQKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873583 - protein, 589 aa, Homo sapiens; identical to SEQ ID NO: 873576

SEQ ID NO: 873584 - protein, 589 aa, Homo sapiens; identical to SEQ ID NO: 873576

SEQ ID NO: 873585 - protein, 346 aa, Homo sapiens
AGWYAPAFGMPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRYALKTSLNSRTKYTYD

SEQ ID NO: 873586 - protein, 589 aa, Homo sapiens; identical to SEQ ID NO: 873576

SEQ ID NO: 873587 - protein, 556 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEASGSLGSFILTLSPNLS

SEQ ID NO: 873588 - protein, 408 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAARP

SEQ ID NO: 873589 - protein, 261 aa, Homo sapiens
AGWYAPAFGMPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGGHPNKGYRTFLMR

SEQ ID NO: 873590 - protein, 101 aa, Homo sapiens
AGWYAPAFGMPTVSVKRDLLFQALGRTYTDEEFDELCFEFGLELDEITSEKEIISKEQGNVKAAGASDVVLYKIDVPGVPFSSPSVLKSSSTGNIYLGFDV

SEQ ID NO: 873591 - protein, 598 aa, Homo sapiens
AGWYAPAFGMPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873592 - protein, 683 aa, Homo sapiens
MSWKDLDDSFPCPFCHLCCPERKFISNPQLGSLTEIAKQLQLRSKRKRQEEKHVCKKHNQVLTFFSQKDLELLCPRCSLSTDHQHRCVWPIKKAASYQKKLEQYNAPWKERVELIEKVITIQTRKSLELKKKTSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873593 - protein, 607 aa, Homo sapiens
MPTVSVKRDLVLAKPTGDCHATSASMASLYVTMFIERSAVVADCEIETVHYCEQRGTSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873594 - protein, 591 aa, Homo sapiens
AGWYAPAFGMPTVSVKRDLLFQALGRTYICFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873595 - protein, 392 aa, Homo sapiens; identical to SEQ ID NO: 873581

SEQ ID NO: 873596 - protein, 461 aa, Homo sapiens
SFTLYFQRFCLFNNMLNFNLLKSLKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873597 - protein, 317 aa, Homo sapiens
MFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINIGPFL

SEQ ID NO: 873598 - protein, 294 aa, Homo sapiens
AGWYAPAFGMPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTST

SEQ ID NO: 873599 - protein, 301 aa, Homo sapiens
AGWYAPAFGMPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTSKAAESGFS

SEQ ID NO: 873600 - protein, 115 aa, Homo sapiens
MSWKDLDDSFPCPFCHLCCPERKFISNPQLGSLTEIAKQLQLRSKRKRQEEKHVCKKHNQVLTFFSQKDLELLCPRCSLSTDHQHRCVWPIKKAASYQEKTGAIQCTVEGESGTN

SEQ ID NO: 873601 - protein, 81 aa, Homo sapiens
AGWYAPAFGMPTVSVKRDLLFQALGRTYTDEEFDELCFEFGLELDEIVCIGYLSIFQRCVHKLIFQGYTVFHLCYLIVRLR

SEQ ID NO: 873602 - protein, 310 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 873603 - protein, 303 aa, Homo sapiens
MEEQNGSGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 873604 - protein, 131 aa, Homo sapiens
PGSGGWDGAEERGAPEGTQLTELRCVRLVCLAPSTGAVRASRLPPQPTRQRSRYQRPVRSVSPQTPCRPPRAGHQIPGYHGLQDSLRSLHLNCRQHRRHYRDSHCRGAAGVWSCSLPKNQAFLLWKTFGRP

SEQ ID NO: 873605 - protein, 310 aa, Homo sapiens; identical to SEQ ID NO: 873602

SEQ ID NO: 873606 - protein, 235 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTQMCWRCGARWAPPSG

SEQ ID NO: 873607 - protein, 310 aa, Homo sapiens; identical to SEQ ID NO: 873602

SEQ ID NO: 873608 - protein, 362 aa, Homo sapiens
VTATYVACSHHLQTFYICLADTASHPLYLQYQLIPLPINLFYILNLISQYSSHLLTKTLFALCILTGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 873609 - protein, 310 aa, Homo sapiens; identical to SEQ ID NO: 873602

SEQ ID NO: 873610 - protein, 103 aa, Homo sapiens
SNSTTCKSIVFSVSHGDRTMERKIRCKVIENSLNKHCMKKPDVRLSFNSNWHLSWLKISAKARRGGSCLSSQHFGRLRQVDRLNLGGGGRSAAEHTPSHTTQG

SEQ ID NO: 873611 - protein, 1111 aa, Homo sapiens
GRGPEPWLGSVQGQRSLLEHHPGKKQMGYMGEMEVQGPTRESGQSLPPQKKAYLSHLSTGSGHIEGDWAGRNRKLLKPRSIQKSWFVQFPWLIMNEEQTALFCSACREYPSIRDKRSRLIEGYTGPFKVETLKYHAKSKAHMFCVNALAARDPIWAARFRSIRDPPGDVLASPEPLFTADCPIFYPPGPLGGFDSMAELLPSSRAELEDPGGDGAIPAMYLDCISDLRQKEITDGIHSSSDINILYNDAVESCIQDPSAEGLSEEVPVVFEELPVVFEDVAVYFTREEWGMLDKRQKELYRDVMRMNYELLASLGPAAAKPDLISKLERRAAPWIKDPNGPKWGKGRPPGNKKMVAVREADTQASAADSALLPGSPVEARASCCSSSICEEGDGPRRIKRTYRPRSIQRSWFGQFPWLVIDPKETKLFCSACIERPNLHDKSSRLVRGYTGPFKVETLKYHEVSKAHRLCVNTVEIKEDTPHTALVPEISSDLMANMEHFFNAAYSIAYHSRPLNDFEKILQLLQSTGTVILGKYRNRTACTQFIKYISETLKREILEDVRNSPCVSVLLDSSTDASEQACVGIYIRYFKQMEVKESYITLAPLYSETADGYFETIVSALDELDIPFRKPGWVVGLGTDGSAMLSCRGGLVEKFQEVIPQLLPVHCVAHRLHLAVVDACGSIDLVKKCDRHIRTVFKFYQSSNKRLNELQEGAAPLEQEIIRLKDLNAVRWVASRRRTLHALLVSWPALARHLQRVAEAGGQIGHRAKGMLKLMRGFHFVKFCHFLLDFLSIYRPLSEVCQKEIVLITEVNATLGRAYVALESLRHQAGPKEEEFNASFKDGRLHGICLDKLEVAEQRFQADRERTVLTGIEYLQQRFDADRPPQLKNMEVFDTMAWPSGIELASFGNDDILNLARYFECSLPTGYSEEALLEEWLGLKTIAQHLPFSMLCKNALAQHCRFPLLSKLMAVVVCVPISTSCCERGFKAMNRIRTDERTKLSNEVLNMLMMTAVNGVAVTEYDPQPAIQHWYLTSSGRRFSHVYTCAQVPARSPASARLRKEEMGALYVEEPRTQKPPILPSREAAEVLKDCIMEPPERLLYPHTSQEAPGMS

SEQ ID NO: 873612 - protein, 259 aa, Homo sapiens
GRGPEPWLGSVQGQRSLLEHHPGKKQMGYMGEMEVQGPTRESGQSLPPQKKAYLSHLSTGSGHIEGDWAGRNRKLLKPRSIQKSWFVQFPWLIMNEEQTALFCSACREYPSIRDKRSRLIEGYTGPFKVETLKYHAKSKAHMFCVNALAARDPIWAARFRSIRDPPGDVLASPEPLFTADCPIFYPPGPLGGFDSMAELLPSSRAELEDPGGDGAIPAMYLDCISDLRQKEITDGIHSSSDINILYNDAVESCIQVIRL

SEQ ID NO: 873613 - protein, 377 aa, Homo sapiens
GRGPEPWLGSVQGQRSLLEHHPGKKQMGYMGEMEVQGPTRESGQSLPPQKKAYLSHLSTGSGHIEGDWAGRNRKLLKPRSIQKSWFVQFPWLIMNEEQTALFCSACREYPSIRDKRSRLIEGYTGPFKVETLKYHAKSKAHMFCVNALAARDPIWAARFRSIRDPPGDVLASPEPLFTADCPIFYPPGPLGGFDSMAELLPSSRAELEDPGGDGAIPAMYLDCISDLRQKEITDGIHSSSDINILYNDAVESCIQDPSAEGLSEEVPVVFEELPVVFEDVAVYFTREEWGMLDKRQKELYRDVMRMNYELLASLEMESHFAAQAGLKLLDSSDPADLAPKVLDYGVSHCTWLAISDEVCCFFPKSSQKSQLHPTVKK

SEQ ID NO: 873614 - protein, 1111 aa, Homo sapiens; identical to SEQ ID NO: 873611

SEQ ID NO: 873615 - protein, 99 aa, Homo sapiens
GVSLLIEDGRVLGSRTKHDSIFSKGNKKMVAVREADTQASAADSALLPGSPVEARASCCSSSICEEGDGPRRIKRTYRPRSIQRSWFGQFPWLVIDPKE

SEQ ID NO: 873616 - protein, 275 aa, Homo sapiens
PFLGSLCTYWSQVTLGPGPDCLILEASRQPRLVPKPERMASDGASALPGPDMSMKPSAALSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEAL

SEQ ID NO: 873617 - protein, 108 aa, Homo sapiens
GIHDTCRNNCSDLHLWRLRQMLILLSNIATACSKTLNIIKEEIGISNCVREKTQTLGVLTGPVRAEFLKLRASYLQERERGGRVLEERQTHSFASLALAFQDPGGGPI

SEQ ID NO: 873618 - protein, 103 aa, Homo sapiens
WGESRRPFLFLGRCFRPKPCPQVILDEPPQTPDLADRINGPQHPPAQAPFCAPRLLWLRPSLPQGTSASVRDGVLHIQPDAVPSSTPNQKARSIQKEKRCLKP

SEQ ID NO: 873619 - protein, 122 aa, Homo sapiens
KYIQIESSSFFIYVVFCFSKVLTISDSKMAKLYHYSYVKVNAMSTIAWTAILTQLSNLNVISIRKPAINCQNGKNSYVCFQSQKCNHVVRLQGFTVVHSSESQDWFPYSVFSHGKLHRGIIG

SEQ ID NO: 873620 - protein, 282 aa, Homo sapiens
RAAWKRVAERRDLGGLAMEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDLGATGASDSRAQLRVHLKEVASAASDGLLRLDLDVPDSGPTVFAPQEVMSVEATSSGDNPGPHDSYQAFLATETQPGERVENPEGGEKTKPCIKEPESLPEEQREQKPREENRDRRDTKRTD

SEQ ID NO: 873621 - protein, 96 aa, Homo sapiens
GCARRGGGGKGTRLVRRLLGALPAGGQGGRQLGPFALLPALALREQSDQTQCQRLLSTYYVQGTGQSERKRPQSPGRVDLKMDWLEGDSPSTRQTR

SEQ ID NO: 873622 - protein, 522 aa, Homo sapiens
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 873623 - protein, 522 aa, Homo sapiens; identical to SEQ ID NO: 873622

SEQ ID NO: 873624 - protein, 522 aa, Homo sapiens; identical to SEQ ID NO: 873622

SEQ ID NO: 873625 - protein, 522 aa, Homo sapiens; identical to SEQ ID NO: 873622

SEQ ID NO: 873626 - protein, 522 aa, Homo sapiens; identical to SEQ ID NO: 873622

SEQ ID NO: 873627 - protein, 145 aa, Homo sapiens
FKATWIEAAWMTTLSEWPHLCTGSAALGSDTETASRASITRILRVSPCHQAGVQWHELSSLQPPPPGFQRFSCLSLPSSWDYRCAPPRPANLCIFSRDGISPCWPGWSQNPDLKQSTCLGLPKCWDYRREPLCPACPLTLEFLPA

SEQ ID NO: 873628 - protein, 1132 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 873629 - protein, 1023 aa, Homo sapiens
MTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 873630 - protein, 1018 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVSCFSHQKHVLVEEKKRMLPEYNHLRIPLPGLIIAYVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCGPDGEGDGSNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQVTRTMYSPPLGNLPALLGCRSW

SEQ ID NO: 873631 - protein, 114 aa, Homo sapiens [sequence omitted]

SEQ ID NO: 873632 - protein, 280 aa, Homo sapiens
MAVARAGVLGVQWLQRASRNVMPLGARTASHMTKDMFPGPYPRTPEERAAAAKKYNMRVEDYEPYLPGDPGAPCSSVLPTTGILTPHPGPQDSWKEAPAPRGNLQRNKLPETFMPPAPITAPVMSLTPELQGILPSQPPVSSVSHAPPGVPGELSLQQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 873633 - protein, 746 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKPARDSSGAKEMRLYIRQVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQVPLLCRVLATPHQALRRLVVEMCRASRGESSGTGWNHGVREERKVLNVWDLLLFPQRRLSSSCFS

SEQ ID NO: 873634 - protein, 139 aa, Homo sapiens
RDSSLTAPCLQCESCSPRSSRRTQPAGDKDNVFPSLGKPSSPPWVQVMVDGPHSSRHVLRETGGRYQVSLLQRKGGCSSPQLCCNGNSVTVSHWGLVLREAMRRTACPSGLSPCFFISSFSTCHLRRWKGRSCPQSISP

SEQ ID NO: 873635 - protein, 1180 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 873636 - protein, 999 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKPARDSSGAKEMRLYIRQVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCGPDGEGDGSNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQVTRTMYSPPLGNLPALLGCRSW

SEQ ID NO: 873637 - protein, 567 aa, Homo sapiens
MRLYIRQVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPSSVDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQVTRTMYSPPLGNLPALLGCRSW

SEQ ID NO: 873638 - protein, 114 aa, Homo sapiens [sequence omitted]

SEQ ID NO: 873639 - protein, 999 aa, Homo sapiens; identical to SEQ ID NO: 873636

SEQ ID NO: 873640 - protein, 223 aa, Homo sapiens [sequence omitted]

SEQ ID NO: 873641 - protein, 291 aa, Homo sapiens
PRGPSVPTRAAAGAIPPMAGHRPSNHFCPLPGSGGGGPRGPMPLRVDTLTWLSTQAAPGRVMVWPAVRPGICPGPDVWRIPLGPLPHEFRGWIAPCRPRLGASEAGDWLRRPSEGALPGPYIALRSIPKLPPPEDISGILKELQQLAKELRQKRLSLGYSQADVGIAVGALFGKVLSQTTICRFEAQQLSVANMWKLRPLLKKWLKEVEAENLLGLCKMEMILQQSGKWRRASRERRIGNSLEKFFQRCPKPTPQQISHIAGCLQLQKDVVRVWFYNRSKMGSRPTNDASP

SEQ ID NO: 873642 - protein, 173 aa, Homo sapiens
SKGCGQTQCRCHKTRPTGVGDFSCHPHTPVSAPFLQVREGAFALHRSFIFKKYVHSHPPSPLVLSDNCCCWYRPPLLLCLLLVSCVNWIFFGSPCNSFGVCLPVLLKMRFLFSLLVLFGWFQEEKGRMLSSCSRVRTESLSISSLPLPAALHVCDCAPWVLLFWVHSYFVSLL

SEQ ID NO: 873643 - protein, 113 aa, Homo sapiens
FDACPIPRTPETHNTGDNEAKSRVFGHFGRSTLAESAGGLQRPKVHLLLTVCSSLLPPPALHRLKSRRPLYRRQLQLLRRKSLSFPFLAPLTPCTHSHFCQAWASRRARGKDQ

SEQ ID NO: 873644 - protein, 77 aa, Homo sapiens
FGQSRTPSNTRGLDCGRSIARAIPGDGDGEMEAQKEKETFLRSHTGARGAARLQPNVVEFLLISGFIIQVTLMFSVL

SEQ ID NO: 873645 - protein, 199 aa, Homo sapiens
LRHRGGALQGGAQEPILGELEHGGLQVPALPHGEAAEAQREFEHCARGTAVLGDRAPPPQLLAWVLSPSLPGAGGDGGRLRVSAGRGAPRPPGTHAGPRTLRAAPVPACVSASTPPRKQRGPAPTLASPERGVPQCSGGLKGSSSLTRADAEAEEALRRSEGRQHVVTSQEFRTTTALTLTLEIRFCAKMGVTKEQMYK

SEQ ID NO: 873646 - protein, 110 aa, Homo sapiens
PGYSHASVHNFHPESYFSDCPHGESMLFPSSYKMLLTDSIHILLILQEPSQISLLPISLPCYTQKWNESPRWLKDALLFWNAFSWCISRLVQFTREKMPGSHSVTQAGVQ

SEQ ID NO: 873647 - protein, 367 aa, Homo sapiens
MLLTLAGGALFFPGLFALCTWALRRSQPGWSRTDCVMISTRYRRRRDAPRGPGRCPPHPTRPRGPGRKRGAAGSPGAAPSASRRPEFPKPLRVLPWRELGPGRAGMADEPPEPAPHICLRLGRVRPKGRGRAPCGPRTGLSARAVLSARARLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 873648 - protein, 103 aa, Homo sapiens
FLRSYLKKDPWAWHYNHFAVRGGLTGPKVVLMQAQGSFLRSYLKSSGRWKHGVGSVDQGGKCLHICLSLYQRLPTFQTTQDSTRGTGPAEARDDLVLGSNVVL

SEQ ID NO: 873649 - protein, 257 aa, Homo sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 873650 - protein, 257 aa, Homo sapiens; identical to SEQ ID NO: 873649

SEQ ID NO: 873651 - protein, 257 aa, Homo sapiens; identical to SEQ ID NO: 873649

SEQ ID NO: 873652 - protein, 225 aa, Homo sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 873653 - protein, 257 aa, Homo sapiens; identical to SEQ ID NO: 873649

SEQ ID NO: 873654 - protein, 147 aa, Homo sapiens
MSDAAEAPREATGENGETEMKEEEEPNPNYKEVEDPQQESKDDTIRTGDESQEEDEENGRGRKRGRSDGDTRPDGPRDTDGPKTICYLRQNNLRTKGCDESPKEDRAGLQGTYPGKENTARIEGPQAERSTDSSPLKSRFGRKHHGF

SEQ ID NO: 873655 - protein, 392 aa, Homo sapiens
RVVVFSDSSCSSSYFLCLNFPTKTPSPEPSNCEGLMEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSHEGGCGAAMRAMCIGLRFPHHSQLDTLIQVSIESGRMTHHHPTGYLGALASALFTAYAVNSRPPLQWGKGLMELLPEAKKYIVQSGYFVEENLQHWSYFQTKWENYLKLRGILDGESAPTFPESFGVKERDQFYTSLSYSGWGGSSGHDAPMIAYDAVLAAGDSWKELAHRAFFHGGDSDSTAAIAGCWWGVMYGFKGVSPSNYEKLEYRNRLEETARALYSLGSKEDTVISL

SEQ ID NO: 873656 - protein, 392 aa, Homo sapiens; identical to SEQ ID NO: 873655

SEQ ID NO: 873657 - protein, 392 aa, Homo sapiens; identical to SEQ ID NO: 873655

SEQ ID NO: 873658 - protein, 357 aa, Homo sapiens
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSHEGGCGAAMRAMCIGLRFPHHSQLDTLIQVSIESGRMTHHHPTGYLGALASALFTAYAVNSRPPLQWGKGLMELLPEAKKYIVQSGYFVEENLQHWSYFQTKWENYLKLRGILDGESAPTFPESFGVKERDQFYTSLSYSGWGGSSGHDAPMIAYDAVLAAGDSWKELAHRAFFHGGDSDSTAAIAGCWWGVMYGFKGVSPSNYEKLEYRNRLEETARALYSLGSKEDTVISL

SEQ ID NO: 873659 - protein, 136 aa, Homo sapiens
GDRSRYWKHLGTMTAHTSPSPHGHTHPTPPLPRHTHIPAYKLRWEGRRKKQKASITQDLSFSLKLRGSLATPHGPQGSPSAATERLRRTYRAHVCRDTDPSSPRPLLFCSSPLEPPSIQLVRPQPSPLPCQFQHTN

SEQ ID NO: 873660 - protein, 130 aa, Homo sapiens
REANEKVLKEVFAKHGPLLEVLLIKGRTSKSRDFVVIIFENAADAKNAARDMNGKSLDGKEIKVEQAKKPSFPSGGRRRPPPSSRNRSPSGSLRSARGSSGGTRPWLPSHEGHLDDGGYALDLNTSSSRG

SEQ ID NO: 873661 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873662 - protein, 1816 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873663 - protein, 1496 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERC

SEQ ID NO: 873664 - protein, 1598 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKGVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873665 - protein, 1680 aa, Homo sapiens
KLRLRGVSSLRLPGPRTRLWGFSDNWAPALRRPSPSALGKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873666 - protein, 721 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873667 - protein, 680 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873668 - protein, 1815 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEKPPRSKASKRIPGQKDLQGARNLLLWALHQHAHRSTGMDGTAVWCFCGEGAFIIHPWHRCPPNCGCAARCLDRGQWLPCNWADV

SEQ ID NO: 873669 - protein, 1474 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKGVYCWPNTDILSKILSFPFISF

SEQ ID NO: 873670 - protein, 1863 aa, Homo sapiens; identical to SEQ ID NO: 873661

SEQ ID NO: 873671 - protein, 1822 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873672 - protein, 1624 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873673 - protein, 760 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873674 - protein, 719 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873675 - protein, 1793 aa, Homo sapiens
MSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 873676 - protein, 36 aa, Homo sapiens
VGQEPEAGGARQRPTTVSHAAGSCSCLFTDCADPSP

SEQ ID NO: 873677 - protein, 149 aa, Homo sapiens
SGRGGAPAHRSRQGFWWPWGIRGVDSPGRGSGSCTDQGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 873678 - protein, 104 aa, Homo sapiens
SLCHLCQLWIRNETTMMQGEVAHGAWLPGLFLMHVCISGAGIKSLWACGFTEWWKKTGGVRDRRLNHDNQLVNQHFGSKIIWECIDQVSARLMLHNKWPPNSEA

SEQ ID NO: 873679 - protein, 158 aa, Homo sapiens
GAGCGWGELVAIRSEEWVEAAAAAAAFAVARTPRSASTSRARRATMSTASSSSSSSSSQTPHPPSQRMRRSAAGSPPAVAAAGSGNGAGGGGGVGCAPAAGAGRLLQPIRATVPYQLLRGSQHSPPFAIPPNTHTPTTHNTSQNPHPTTNQTPHLPPP

SEQ ID NO: 873680 - protein, 184 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEVQIARKLQCIADQFHRLHVQQHQQNQNRVWWQILLFLHNLALNGEENRNGAGPR

SEQ ID NO: 873681 - protein, 184 aa, Homo sapiens; identical to SEQ ID NO: 873680

SEQ ID NO: 873682 - protein, 184 aa, Homo sapiens; identical to SEQ ID NO: 873680

SEQ ID NO: 873683 - protein, 184 aa, Homo sapiens; identical to SEQ ID NO: 873680

SEQ ID NO: 873684 - protein, 184 aa, Homo sapiens; identical to SEQ ID NO: 873680

SEQ ID NO: 873685 - protein, 92 aa, Homo sapiens
KKGRGVLPGMALVGQQPRCLRCPLTGEMEPSQCVEELEDDVFQPEDGEPVTQPGSLLSADLFAQSLLDCPLSRLQLFPLTHCCGPGLRPTSQ

SEQ ID NO: 873686 - protein, 222 aa, Homo sapiens
SGRRPHRHVPLELRQRGGGGSRTSMHHRNDSQRLGKAGCPPEPSLQMANTNFLSTLSPEHCRPLAGECMNKLKCGAAEAEIMNLPERVGTFSAIPALGGISLPPGVIVMTALHSPAAASAAVTDSAFQIANLADCPQNHSSSSSSSSGGAGGANPAKKKRKRCGVCVPCKRLINCGVCSSCRNRKTGHQICKFRKCEELKKKPGTSLERTPVPSAEAFRWFF

SEQ ID NO: 873687 - protein, 375 aa, Homo sapiens
MARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 873688 - protein, 300 aa, Homo sapiens
MARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRFFATLHCCKQCSDEHLWN

SEQ ID NO: 873689 - protein, 123 aa, Homo sapiens
TAILWSLRHPEGWTMQMGFPSFLFFSRVCVGAEGGPNERGSGTERSPHAYQPPSPQPLHFNGYLGFPELRPARLSVLMLLSRSQFALKFLDPSFVPITNSLTQELQEKPSKWKFNRTAFLHQR

SEQ ID NO: 873690 - protein, 403 aa, Homo sapiens
MTAILWSLRHPEGWTMQMGFPSFLFFSRVCVGAEGGPNERGSGTERSPHAYQPPSPQPLHFNGYLGFPELRPARLSVLMLLSRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 873691 - protein, 110 aa, Homo sapiens
TGNVGTHAATSDCTNSHCVPQSQALSLTVKKQSQFHLRIFLTRQETLLTLLNFSYRTHLLSVQCYEVGIPPSLYGCTLTVFRKSTCEIVWFELTYMFFSFFMKHHFYLKE

SEQ ID NO: 873692 - protein, 136 aa, Homo sapiens
MSLKHPSRESGVCSATLCPIPRPSPPPLFLCLHELSLTGRGFPQAGGLGAGSMSWAGTTTEGFRPGFFPTAGCSEGVLPGLPCPPERGLGVRPRPVREFGVRFLRSPHSACGRCTCHLKTPKTLLGTVVNKMFLRM

SEQ ID NO: 873693 - protein, 562 aa, Homo sapiens
HGSGAPGRGRGVASVRGGGRCRHQGLFLRAVLPRPACAGQSWYPLERAVAESGAGTGWRVAARRGGGGAGLWLLLPLHVAGGRRAVQFAHSSPAASPSGSPRVTGAMAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873694 - protein, 334 aa, Homo sapiens
HGSGAPGRGRGVASVRGGGRCRHQGLFLRAVLPRPACAGQSWYPLERAVAESGAGTGWRVAARRGGGGAGLWLLLPLHVAGGRRAVQFAHSSPAASPSGSPRVTGAMAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDTKENLGRRCKCSTIRY

SEQ ID NO: 873695 - protein, 562 aa, Homo sapiens; identical to SEQ ID NO: 873693

SEQ ID NO: 873696 - protein, 652 aa, Homo sapiens
HGSGAPGRGRGVASVRGGGRCRHQGLFLRAVLPRPACAGQSWYPLERAVAESGAGTGWRVAARRGGGGAGLWLLLPLHVAGGRRAVQFAHSSPAASPSGSPRVTGAMAFAETYPAASSLPNGDCGRPRARPGGNRVTVVLGAQWGDEGKGKVVDLLAQDADIVCRCQCAPYMKVKEKLLLLVGPRGRNPFSVQKKGDLVMLWGRRIRIPSFLAVDSGREAEACVSPSLTSGHLVNMEIAQVELHYGLEEGLENTTIMGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873697 - protein, 412 aa, Homo sapiens
ELRAAVPRRNCVVSAAQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873698 - protein, 233 aa, Homo sapiens
MEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873699 - protein, 172 aa, Homo sapiens [sequence omitted]

SEQ ID NO: 873700 - protein, 214 aa, Homo sapiens
MEKIKPMVRDGVYFLYEALHGPTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873701 - protein, 54 aa, Homo sapiens
YLSNLQGVAIKFLPRTFLGNTPEIQPLPTFCLTFRSGHAVGKTYPNTELSCCRQ

SEQ ID NO: 873702 - protein, 562 aa, Homo sapiens; identical to SEQ ID NO: 873693

SEQ ID NO: 873703 - protein, 456 aa, Homo sapiens
MAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 873704 - protein, 499 aa, Homo sapiens
HGSGAPGRGRGVASVRGGGRCRHQGLFLRAVLPRPACAGQSWYPLERAVAESGAGTGWRVAARRGGGGAGLWLLLPLHVAGGRRAVQFAHSSPAASPSGSPRVTGAMAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPGIFF

SEQ ID NO: 873705 - protein, 241 aa, Homo sapiens
HGSGAPGRGRGVASVRGGGRCRHQGLFLRAVLPRPACAGQSWYPLERAVAESGAGTGWRVAARRGGGGAGLWLLLPLHVAGGRRAVQFAHSSPAASPSGSPRVTGAMAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGGRSRSRTSPRVRDPRV

SEQ ID NO: 873706 - protein, 96 aa, Homo sapiens
GNAEIIEGTRLRILTRFGCFLSCFPRVWPLLVLASSFSAEMESHHVAQAGLKLLSSRNPPTLTSQSAGIIEMSHHAWAPNSRSWRKWKKGDIDDLS

SEQ ID NO: 873707 - protein, 45 aa, Homo sapiens
MGQSSMQLPLCLTPCLMQRRRSTQSRKVDAKKKGSNAEKKGFGRQ

SEQ ID NO: 873708 - protein, 132 aa, Homo sapiens
LWQRQEDRSEQAQGGRTEEGRGKNRGGNCDSCVAAVLHTNRWLSSLCDSTSVCFPQASQISLQLLLFSKHAVSWPHRPRAFSFVRVHNSYMNFFWYKYTVCNNQIRVAGIPLTSNTAHSFVLGYSKSSLLAI

SEQ ID NO: 873709 - protein, 507 aa, Homo sapiens
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 873710 - protein, 294 aa, Homo sapiens
MPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 873711 - protein, 95 aa, Homo sapiens
LVPRRLRKGTRPEVTQQGRVPFPCVKDTPHRRLRGGLRGQGWRQPSNVVISSRSDLVASGCARKTRLCPHKSYGHHREHPGLKKPGQAGHSGSRL

SEQ ID NO: 873712 - protein, 274 aa, Homo sapiens
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQALGDLTDLPVVPKATYGLKHAESIMSFHIDWGLPCWVDVLRSLGKDGVDPESGARGYPWPCMGPLCHSTQGPPKRGGPPPGGGSRLARIGVL

SEQ ID NO: 873713 - protein, 274 aa, Homo sapiens; identical to SEQ ID NO: 873712

SEQ ID NO: 873714 - protein, 101 aa, Homo sapiens
MAGYQNKNTETLYTTKCKATSGMFPSLQGPHDAELLSILKVHLGNLRLQDRLLFSRGQHIRSAMDKPRPGKTTFVIMVSPLDFPKCGKLDCIICGSRGKRR

SEQ ID NO: 873715 - protein, 279 aa, Homo sapiens
ERRTESSGTLEDALCLRRSFCLPVLMPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKA

SEQ ID NO: 873716 - protein, 431 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 873717 - protein, 199 aa, Homo sapiens
SDNKRLGARLGGGYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 873718 - protein, 199 aa, Homo sapiens; identical to SEQ ID NO: 873717

SEQ ID NO: 873719 - protein, 199 aa, Homo sapiens; identical to SEQ ID NO: 873717

SEQ ID NO: 873720 - protein, 78 aa, Homo sapiens
WSGGWKHKDISKILGQFKQGLGADDKPTHSAKKQGLGETGNWKRLFRRGQSESGRRDSRGTHSTHKGPEAGTEGPQAT

SEQ ID NO: 873721 - protein, 77 aa, Homo sapiens
VMIRSSAVPMSNLGMHMLMFTNWHLENNSPYLITTKNFGKYISPPWEFSKDFKILISTTSLFPKVAYFLSHVRSTSH

SEQ ID NO: 873722 - protein, 76 aa, Homo sapiens
GKASLPTTAAWMLMAEAKVPLPGRKFRLRPTSHGLEGSSGGWVRGCSSSCFFNRGWSRSLQGGGGASGGVRSSFTL

SEQ ID NO: 873723 - protein, 453 aa, Homo sapiens
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 873724 - protein, 435 aa, Homo sapiens
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 873725 - protein, 128 aa, Homo sapiens [sequence omitted]

SEQ ID NO: 873726 - protein, 453 aa, Homo sapiens; identical to SEQ ID NO: 873723

SEQ ID NO: 873727 - protein, 453 aa, Homo sapiens; identical to SEQ ID NO: 873723

SEQ ID NO: 873728 - protein, 453 aa, Homo sapiens; identical to SEQ ID NO: 873723

SEQ ID NO: 873729 - protein, 355 aa, Homo sapiens [sequence omitted]

SEQ ID NO: 873730 - protein, 39 aa, Homo sapiens
IHIPDAEPESPTSLLPVLRQRLLCALPLAGHWVGAHEDR

SEQ ID NO: 873731 - protein, 87 aa, Homo sapiens
SRDPSRTPSALRTPPSPLPPAPFASPALSSCPEPRSRPGSRASGASTSSPAEALPGSSPDLILPAAGTDQAGRGGVGTAAAATRAGQ

SEQ ID NO: 873732 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873733 - protein, 578 aa, Homo sapiens; identical to SEQ ID NO: 873732

SEQ ID NO: 873734 - protein, 400 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPDQRSARPQAGQPHGVVLPGRDCEIPLPPV

SEQ ID NO: 873735 - protein, 510 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVPPGGGPGGGGTLQNTTTGPQADKNGGHEHPRGERATAKPQQERAAPEPKTLTY

SEQ ID NO: 873736 - protein, 541 aa, Homo sapiens
MPFRLLIPLGLLCALLPQHHGAPGPDGSAPDPAHYSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873737 - protein, 537 aa, Homo sapiens
MFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873738 - protein, 426 aa, Homo sapiens
MAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873739 - protein, 103 aa, Homo sapiens
MSPVCPPSPVVLACLVSSPHVPASLTPPPTRGSPEIAENSKRSPGTGKKSRQGRLRSLHPSLLPSLHPDPAQTFVTTPSLSPAGWVGGIPLCRWLPEAGQASW

SEQ ID NO: 873740 - protein, 217 aa, Homo sapiens
MEVAGLFLGGRGAGQRVPSVLLAWASWRLLGRIPSPCAGRGLEALGRDWRGTVAEPRPEAQGRVPSFRSNARRVRSVRGGGVTAPAPPDAEVGSGRPAGLAARDHGGSAKRRPRRPGACANPAPAPAPACGAGGPGTAPASAPAPAPAPAPAPARAQPVGAAGRRALPHRLHFLVLTASSAGCRPSVRRPLWFLPALSPLPTSLRLLHPLPPEAPQR

SEQ ID NO: 873741 - protein, 418 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIREYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873742 - protein, 157 aa, Homo sapiens
TRYDPQRILLLLGEYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873743 - protein, 114 aa, Homo sapiens
MEVAGLFLGGRGAGQRVPSVLLAWASWRLLGRIPSPCAGRGLEALGRDWRGTVAEPRPEAQGRVPSFRSNARRVRSVRGGGVTAPAPPDAEVGSGRPAGLAARDWVTQGVPGVH

SEQ ID NO: 873744 - protein, 578 aa, Homo sapiens; identical to SEQ ID NO: 873732

SEQ ID NO: 873745 - protein, 560 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873746 - protein, 537 aa, Homo sapiens; identical to SEQ ID NO: 873737

SEQ ID NO: 873747 - protein, 277 aa, Homo sapiens [sequence omitted]

SEQ ID NO: 873748 - protein, 163 aa, Homo sapiens
MEVAGLFLGGRGAGQRVPSVLLAWASWRLLGRIPSPCAGRGLEALGRDWRGTVAEPRPEAQGRVPSFRSNARRVRSVRGGGVTAPAPPDAETMGAQLSGGRGAPEPAQTQPQPQPQPAAPEGPEQPRHPPQPQPQPQPQPQPEPSPWGPLDDVRFLIACTSWY

SEQ ID NO: 873749 - protein, 460 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 873750 - protein, 163 aa, Homo sapiens; identical to SEQ ID NO: 873748

SEQ ID NO: 873751 - protein, 163 aa, Homo sapiens; identical to SEQ ID NO: 873748

SEQ ID NO: 873752 - protein, 288 aa, Homo sapiens
HQIHQVRAVLTTTFPFVSIMSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGPQGPPPAGLLH

SEQ ID NO: 873753 - protein, 280 aa, Homo sapiens
HQIHQVRAVLTTTFPFVSIMSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 873754 - protein, 42 aa, Homo sapiens
IAPLKTQYWKLVLEDKPWQAEGTCSSVCPPGTTRRVTGRWAE

SEQ ID NO: 873755 - protein, 70 aa, Homo sapiens
FELPYVTSLIPDSNKRHHSVIIESAGDESLQASGRIPAHLEEPFHIPGSQVLHPLTRYVVPENHYLKNGC

SEQ ID NO: 873756 - protein, 134 aa, Homo sapiens
MKAFSPVRSIRKNSLLDHRLGISQSKTPVDDLMSLLYNMNDCYSKLKELVPSIPQNKNVSKMEILQHVIDYILDLQITLDLHPTIVSLHHQRPGQNQASRMPLTTLNTDISILSLQASEFPSELMSNDRKALCG

SEQ ID NO: 873757 - protein, 591 aa, Homo sapiens
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 873758 - protein, 369 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873759 - protein, 319 aa, Homo sapiens [sequence omitted]

SEQ ID NO: 873760 - protein, 322 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEAQEFDGSDSGARPDEAVSWGKIRVDAQPVKVYADASLVFPLLVAETFAQKMDAFMHEKNED

SEQ ID NO: 873761 - protein, 313 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEGARPDEAVSWGKIRVDAQPVKVYADASLVFPLLVAETFAQKMDAFMHEKNED

SEQ ID NO: 873762 - protein, 277 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEAERGRLRCLHQHSPGV

SEQ ID NO: 873763 - protein, 280 aa, Homo sapiens [sequence omitted]

SEQ ID NO: 873764 - protein, 353 aa, Homo sapiens
SGEGTGSERRCSLIPKRVGAGWARWRMPIIPAFWEAEAGGSREEEFETSLANMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873765 - protein, 405 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMQSSLIRVLDKDEVRSSAQNEEQGLPSWAKFTALWLQVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873766 - protein, 246 aa, Homo sapiens [sequence omitted]

SEQ ID NO: 873767 - protein, 335 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQFTALWLQVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873768 - protein, 186 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQAGAWSSTTLPMPTSCGTGPTTLFTSTQPRSLMALTQVPDQTRLSPGARSGWMHSPSRSMLTPPWSSPCLWLKPLPRRWMPSCMRRTRTERLRSQEGLTPSSIY

SEQ ID NO: 873769 - protein, 285 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQFTALWLQVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLKVNSHHRPSLAQVARGMILLARGGVGPSQPHLANGPTSMRNGGRTKLFTLKPGQEF

SEQ ID NO: 873770 - protein, 72 aa, Homo sapiens
SSSVSCMICIHLLGKGFSHKQGEDQGGVCIDLDGLCIHPDLVYADASLVFPLLVAETFAQKMDAFMHEKNED

SEQ ID NO: 873771 - protein, 369 aa, Homo sapiens; identical to SEQ ID NO: 873758

SEQ ID NO: 873772 - protein, 369 aa, Homo sapiens; identical to SEQ ID NO: 873758

SEQ ID NO: 873773 - protein, 322 aa, Homo sapiens; identical to SEQ ID NO: 873760

SEQ ID NO: 873774 - protein, 396 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEVGLGQPGGASSVGVRGGMALKVTSSPEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873775 - protein, 448 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVGPGEAVALASGSMGNAVIDRLSEMGRYGVCYKQRNRIKFCFVAELPHKSHWTRMRLEVLPRRGQGLPSWAKFTALWLQVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873776 - protein, 186 aa, Homo sapiens
MPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 873777 - protein, 199 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGL

SEQ ID NO: 873778 - protein, 145 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGILKPLPRRWMPSCMRRTRTERLRSQEGLTPSSIY

SEQ ID NO: 873779 - protein, 908 aa, Homo sapiens
MARERSSAAAGRKQFCKNNHTQPGNCLPLGLSLSRRPHSLQGGGHRIYRGKNIPPSQQITMLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 873780 - protein, 858 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 873781 - protein, 918 aa, Homo sapiens
MARERSSAAAGRKQFCKNNHTQPGNCLPLGLSLSRRPHSLQGGGHRIYRGKNIPPSQQITMLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 873782 - protein, 892 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVPLLHRHLLARLPPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 873783 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 873784 - protein, 760 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVPLLHRHLLARLPPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 873785 - protein, 648 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMSARVTPEPGASSDVNTNHQTSRLPIIN

SEQ ID NO: 873786 - protein, 129 aa, Homo sapiens
MGEPPSSCLIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGLPSSDHVMLEVPGLD

SEQ ID NO: 873787 - protein, 848 aa, Homo sapiens; identical to SEQ ID NO: 873783

SEQ ID NO: 873788 - protein, 848 aa, Homo sapiens; identical to SEQ ID NO: 873783

SEQ ID NO: 873789 - protein, 760 aa, Homo sapiens; identical to SEQ ID NO: 873784

SEQ ID NO: 873790 - protein, 661 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVPLLHRHLLARLPLFHCLHQIQLGLFLPLQPQNQLKTLHRITAVTCSKLVFIML

SEQ ID NO: 873791 - protein, 176 aa, Homo sapiens
MARERSSAAAGRKQFCKNNHTQPGNCLPLGLSLSRRPHSLQGGGHRIYRGKNIPPSQQITMLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEAYFTKRLPP

SEQ ID NO: 873792 - protein, 71 aa, Homo sapiens
MAGGEAGTFFTRQQEMEMQAGKCQMLIKPSDLMRTHYHKNIMGETAPMIQSLPSLDVRLTGPSLDTWGLQF

SEQ ID NO: 873793 - protein, 121 aa, Homo sapiens
CALGHAVPAAWKASVLHPRALTLLLRTPIHPSKPSLSVPSPGSPPLTCQSPPSGSPASFSVWLLRTLMTDCPTSWRSQTRAFSSTGVVWFARFTLQAPSTEPDWVPEGAPRLRLAPPAPCL

SEQ ID NO: 873794 - protein, 376 aa, Homo sapiens
MFNPHALDVPAVIFDNGSGLCKAGLSGEIGPRHVISSVLGHCKFNVPLARLNQKYFVGQEALYKYEALHLHYPIERGLVTGWDDMEKLWKHLFERELGVKPSQQPVLMTEPSLNPREIREKLAEMMFETFSVPGFYLSNHAVAALYASACVTGLVVDSGDGVTCTVPIFEGYSLPHAVTKLCMAGRDITEHLTRLLFASGFNFPCILNKAVVNNIKEKLCYIALEPEKELRKSRGEVLGAYRLPDGHVIHFGDELYQVPEVLFAPDQLGIHSPGLSKMVSSSIMKCDTDIQNKLYADIVLSGGTTLLPGLEERLMKEVEQLASKGTPIKITASPDRCFSAWIGASIMTSMSSFKQMWVTSADFKEYGTSVVQRRCF

SEQ ID NO: 873795 - protein, 115 aa, Homo sapiens
HFYQFWNHSSSMAKFLFMSQVSEHGLIFPVQTGRSAALLIQLTTVHCSDVQGVGVDTFQLAGVWNGTSHSQRRDSLWRLSWQCSSLPCGWHVGHQQSSEYQPAKLRPSWGTEIYC

SEQ ID NO: 873796 - protein, 103 aa, Homo sapiens [sequence omitted]

SEQ ID NO: 873797 - protein, 203 aa, Homo sapiens
SEHNLSPEPLELDRMPHSPLISIPHVWCHPEEEERMHDELLQAVSKGPVMFRDVSIDFSQEEWECLDADQMNLYKEVMLENFSNLVSVGLSNSKPAVISLLEQGKEPWMVDRELTRGLCSDLESMCETKILSLKKRHFSQVIITREDMSTFIQPTFLIPPQKTMSEEKPWECKICGKTFNQNSQFIQHQRIHFGEKHYESKEY

SEQ ID NO: 873798 - protein, 107 aa, Homo sapiens
KKNINYKYGSSYESVAKINEKLVQLIEDYSLVSFIPLNIQDKESIQRVLQAVDKANGYCFGAQEQRSLEAMMSAAMGADFHFSSTLGIQEKYLAPSNQSVEQEAMQL

SEQ ID NO: 873799 - protein, 183 aa, Homo sapiens
MAGAAPTTAFGQAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRLTAVHLVDSHYCTDPAKFISVLCTSLATMLHVELPPHQPPFQDGPH

SEQ ID NO: 873800 - protein, 183 aa, Homo sapiens; identical to SEQ ID NO: 873799

SEQ ID NO: 873801 - protein, 183 aa, Homo sapiens; identical to SEQ ID NO: 873799

SEQ ID NO: 873802 - protein, 183 aa, Homo sapiens; identical to SEQ ID NO: 873799

SEQ ID NO: 873803 - protein, 258 aa, Homo sapiens
GTEEQHKEGTDETETDCQRIGRSMTGRYYIRDVTLAIRSLCDLATRYATQIAFRAWFACGTDRETQRTNEKGKHASQKQQDFGDKKTAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRLTAVHLVDSHYCTDPAKFISVLCTSLATMLHVELPPHQPPFQDGPH

SEQ ID NO: 873804 - protein, 183 aa, Homo sapiens; identical to SEQ ID NO: 873799

SEQ ID NO: 873805 - protein, 134 aa, Homo sapiens
MILVAPEHWFLSLAFNLDYYTEVLDLSYLLDHLASDPFFRHYRQLNEKLVQLIEDYSLVSFIPLNIQDKESIQRVLQAVDKANGYCFGAQEQRSLEAMMSAAMGADFHFSSTLGIQEKYLAPSNQSVEQEAMQL

SEQ ID NO: 873806 - protein, 71 aa, Homo sapiens
QALILMRECLSLFLQATLTLSIPSQLTAVHLVDSHYCTDPAKFISVLCTSLATMLHVELPPHQPPFQDGPH

SEQ ID NO: 873807 - protein, 183 aa, Homo sapiens; identical to SEQ ID NO: 873799

SEQ ID NO: 873808 - protein, 183 aa, Homo sapiens; identical to SEQ ID NO: 873799

SEQ ID NO: 873809 - protein, 183 aa, Homo sapiens; identical to SEQ ID NO: 873799

SEQ ID NO: 873810 - protein, 131 aa, Homo sapiens
MDLIEHYGKLAFNLDYYTEVLDLSYLLDHLASDPFFRHYRQLNEKLVQLIEDYSLVSFIPLNIQDKESIQRVLQAVDKANGYCFGAQEQRSLEAMMSAAMGADFHFSSTLGIQEKYLAPSNQSVEQEAMQL

SEQ ID NO: 873811 - protein, 145 aa, Homo sapiens
MAGAAPTTAFGQAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRPPYCQWCP

SEQ ID NO: 873812 - protein, 223 aa, Homo sapiens
KQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 873813 - protein, 223 aa, Homo sapiens; identical to SEQ ID NO: 873812

SEQ ID NO: 873814 - protein, 188 aa, Homo sapiens
KQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYISSTTPTMPNCTVIFNNGNHEAVKSMFHTQMRIELRALGKISEGEELTVSFYSSSYPQNLAQILECGRCSVNVC

SEQ ID NO: 873815 - protein, 57 aa, Homo sapiens
GIFPNLGLVNHDCWPNCTVIFNNGNHEAVKSMFHTQMRIELRALGKISEGEELTVSY

SEQ ID NO: 873816 - protein, 89 aa, Homo sapiens
RPLQHQNGIGFADNNDKAYAILLVTHGPSHPITKDLEAMRVQTEMELRMFRQNEFMYYKMREAALNNQPMQVMAEPSNEPSPALFHKKQ

SEQ ID NO: 873817 - protein, 103 aa, Homo sapiens
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVLQED

SEQ ID NO: 873818 - protein, 244 aa, Homo sapiens
KQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKNAISKNAENSWILIFMTEFFLVV

SEQ ID NO: 873819 - protein, 715 aa, Homo sapiens
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITPSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 873820 - protein, 80 aa, Homo sapiens
HQQCSYKILTSVDQYLELIGNSLPGTTAKAAVPPSSRVIQSHSPCKGILGQLWFEYAVCIVFLPLVPCHSFKTLLSFPIS

SEQ ID NO: 873821 - protein, 132 aa, Homo sapiens
HIVILILDTQAAEKYDCMVFSSSQVSPFIDDNTRRKFLIYAGNDYQGPGGLLDYIDKEIIPDFLSGECMVCPEARNCTFGPLCRWKGGGKTFKFIYFFCKVYLHGIRTLTFCFSPFLNNLRNFISLHVLLSG

SEQ ID NO: 873822 - protein, 672 aa, Homo sapiens [sequence omitted]

SEQ ID NO: 873823 - protein, 715 aa, Homo sapiens; identical to SEQ ID NO: 873819

SEQ ID NO: 873824 - protein, 466 aa, Homo sapiens
FRLVRPRGMGYRGPTASRETHKCTIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 873825 - protein, 256 aa, Homo sapiens
AVVDLEESRYNAKVIGRRDFRGSMTSLESSHSGFSQLSAATTPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 873826 - protein, 715 aa, Homo sapiens; identical to SEQ ID NO: 873819

SEQ ID NO: 873827 - protein, 116 aa, Homo sapiens
RTRTPTHLRLGSEAWVFSHPHCQFSSQPSVGHLLCALWWLIVSEPRQFQPLGGRLGTSKSHLPLDTVHGVLLVAKQQLSHPLQGGVWHVGVLLLCTWELWTHACVCVHVLCVCMCA

SEQ ID NO: 873828 - protein, 715 aa, Homo sapiens; identical to SEQ ID NO: 873819

SEQ ID NO: 873829 - protein, 715 aa, Homo sapiens; identical to SEQ ID NO: 873819

SEQ ID NO: 873830 - protein, 386 aa, Homo sapiens [sequence omitted]

SEQ ID NO: 873831 - protein, 306 aa, Homo sapiens
HRAWCMTCSRIQRLNGWWCVTLGKEIRPYAFSVSLPSFSTCTLDPLESTMRSQHAGLVLVDRGCLTLPLFQILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRCGHPRHSRCCGQLGMVGGSLQSHAVCRISSGGGCQECLEGQEGVALGSFVGTVTPCLSAEGECRRQSRLTAFALAHTAVCVQAVGSRSPWW

SEQ ID NO: 873832 - protein, 50 aa, Homo sapiens
MGGPGEFWKDLGKGPGRKIQASGSNGNTGLEPAKVETGVNSPEKEGDSRL

SEQ ID NO: 873833 - protein, 715 aa, Homo sapiens; identical to SEQ ID NO: 873819

SEQ ID NO: 873834 - protein, 391 aa, Homo sapiens
MVLTTHSFPSSADGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 873835 - protein, 719 aa, Homo sapiens
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITPSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISRWRFC

SEQ ID NO: 873836 - protein, 715 aa, Homo sapiens; identical to SEQ ID NO: 873819

SEQ ID NO: 873837 - protein, 715 aa, Homo sapiens; identical to SEQ ID NO: 873819

SEQ ID NO: 873838 - protein, 572 aa, Homo sapiens
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITPSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSLSLRP

SEQ ID NO: 873839 - protein, 209 aa, Homo sapiens
NHCAQPAPKLAPILNMELQCAAGNFLCPAGALSFNAFKTVMDIDTSGTFNVSRVLYEKFFRVGASALCEKFFRDHGGVIVNITATLGNRGQALQVHAGSAKAAVDAMTRHLAVEWGPQNIRVNSLAPGPISGTEGLRRLGIFRPLLPAASLSQVESTNLNQQCLQPSPSSEHSAITALSLPTPMVKGVLPAWVQGLREPHGSRDLCSLG

SEQ ID NO: 873840 - protein, 208 aa, Homo sapiens
MDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 873841 - protein, 105 aa, Homo sapiens [sequence omitted]

SEQ ID NO: 873842 - protein, 364 aa, Homo sapiens
RGSRFQASSQLRAGSWRPRPLPPVVPAVPDGSAMAQPPPDVEGDDCLPAYRHLFCPDLLRDKVAFITGGGSGIGFRIAEIFMRHGCHTVIASRSLPRVLTAVLPQSGVQQQTQGPRGTRKHRPLQIPKAFSPGRGCRAAVCLFTWLAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGIFRPLLPAASLSQVESTNLNQQCLQPSPSSEHSAITALSLPTAPTPGQEQLDSGPGPWSCHAGA

SEQ ID NO: 873843 - protein, 158 aa, Homo sapiens
HGGVIVNITATLGNRGQALQVHAGSAKAAVGMTTPPRPGLPTWVPNGPSASIPGGQQSPLEAEPSCRQRDLALALRPRRGQSGLSYPTFFCADAMTRHLAVEWGPQNIRVNSLAPGPISGTEGLRRLGKALREPRPPTDPLLGHRVPMKLPEPWQGVC

SEQ ID NO: 873844 - protein, 325 aa, Homo sapiens
RGSRFQASSQLRAGSWRPRPLPPVVPAVPDGSAMAQPPPDVEGDDCLPAYRHLFCPDLLRDKVAFITGGGSGIGFRIAEIFMRHGCHTVIASRSLPRVLTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 873845 - protein, 296 aa, Homo sapiens
GQVRPESDWDVRPQVPGPAAARPPQLPPHRTIHVPGLPPSASGIGFRIAEIFMRHGCHTVIASRSLPRVLTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 873846 - protein, 307 aa, Homo sapiens
GQVRPESDWDVRPQVPGPAAARPPQLPPHRTIHVPGLPPSASGIGFRIAEIFMRHGCHTVIASRSLPRVLTAARKLAGATGRRCLPLSMDVRAPPAVMAAVDQALKEFGRIDILINCSSSSCGSHSAGAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 873847 - protein, 318 aa, Homo sapiens
RGSRFQASSQLRAGSWRPRPLPPVVPAVPDGSAMAQPPPDVEGDDCLPAYRHLFCPDLLRDKVAFITGGGSGIGFRIAEIFMRHGCHTVIASRSLPRVLTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGIFRPLLPAASLSQVESTNLNQQCLQPSPSSEHSAITALSLPTAPTPGQEQLDSGPGPWSCHAGA

SEQ ID NO: 873848 - protein, 325 aa, Homo sapiens; identical to SEQ ID NO: 873844

SEQ ID NO: 873849 - protein, 169 aa, Homo sapiens
DFKPSIYSSTIPTPTTPRSYSLNPLTPDLLLTLSSFMPPGSLPGLDHMVYPQSSHRFFCAMLNSLMPPPSTVLTWQNPNPRLNPTPCPLLPSPALHLGCRKQNSFRAPAQLPIQSFLLEPPGTGLLFSPFHSYSSYQSHQRSPRYQAHSETRLFLAPALAASDIDITLL

SEQ ID NO: 873850 - protein, 1098 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVAMMQIVSCPYVKTVATTKTGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873851 - protein, 1011 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYS

SEQ ID NO: 873852 - protein, 1077 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873853 - protein, 635 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRMSKKSFMWIARASLFRYKAKSLFFLA

SEQ ID NO: 873854 - protein, 1094 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRMSKKSFMWIARASLFRRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873855 - protein, 412 aa, Homo sapiens
LPLEDPPPFTTISKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873856 - protein, 264 aa, Homo sapiens
MREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873857 - protein, 320 aa, Homo sapiens [sequence omitted]

SEQ ID NO: 873858 - protein, 964 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAVRISYFSHFNLDESC

SEQ ID NO: 873859 - protein, 1077 aa, Homo sapiens; identical to SEQ ID NO: 873852

SEQ ID NO: 873860 - protein, 1060 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873861 - protein, 1077 aa, Homo sapiens; identical to SEQ ID NO: 873852

SEQ ID NO: 873862 - protein, 466 aa, Homo sapiens
METSVWFYVSFINRYPVDFKQNYDLYIFRGDLIMRQYVFILKVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 873863 - protein, 184 aa, Homo sapiens
MIHIGNKKYCNGLGQISSLMDLSYLISTCIRMVSKPGKEALWFLMLPLPAGFILRLTRTFRQVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYS

SEQ ID NO: 873864 - protein, 120 aa, Homo sapiens
SSVAQQQRFAKRTPTVPQPTLRTHPLTFSASCGVRLSNQAQSWPKNQAEKRGRCHAKLLRGSWGRFSFLIKGRGAPRGVSLVPTLILSRINVYSKRVRSLFALLRDVSQWHNRCSLKKME

SEQ ID NO: 873865 - protein, 112 aa, Homo sapiens
QGNSDREGEMGRWVKVRREADSAGRGNSSLQESRCTGPLRGPCACGIPRGAWGTAGAQPCRVRRVRPPRRTRRCLGEVKGLVDLRWPGYPTGTPRAQAGLCTSKPPTTAPGP

SEQ ID NO: 873866 - protein, 118 aa, Homo sapiens
AAAAQPALSAPRSDSGAHQAGTRARARRAPLLLLSVPGSRSPNAPRRGCARQWSRSELLGFGGRSLLRLAGGPAGKEGESGDTHTRRGARALHTRSRAPPPRRVRSEFGPAAPAPAPA

SEQ ID NO: 873867 - protein, 192 aa, Homo sapiens
HEMTSIGLLLGVSAAKLGTMDMSITRLLSIRIPALLPPTSTELDVPHNVQVAAVVGIGLVYQGTAHRHTAEVLLAEIGRPPGPEMEYCTDRESYSLAAGLALGMVCLGHGSNLIGMSDLNVPERLYQYMVGGHRRFQTGMHREKHKSPSYQIKEGDTINVDVTWPGATLALAMIYLKTNNSASRKPRHMEKF

SEQ ID NO: 873868 - protein, 309 aa, Homo sapiens
MSSPRAVVQLGKAQPAGEELATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 873869 - protein, 275 aa, Homo sapiens
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 873870 - protein, 130 aa, Homo sapiens
EPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSG

SEQ ID NO: 873871 - protein, 72 aa, Homo sapiens
RWSQNADISQRDVDTRWNVASKPLGKDCEDARPIKEDDDADMGAKCVESFVASIWRRHVEDSMENQHIGNKN

SEQ ID NO: 873872 - protein, 416 aa, Homo sapiens
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 873873 - protein, 174 aa, Homo sapiens
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQCFLLFPRLTAWQRRLWRQWRLTSSC

SEQ ID NO: 873874 - protein, 474 aa, Homo sapiens
MSIQAPPRLLELAGQSLLRDQALSISAMEELPRVLYLPLFREAFSRRHFQTLTVMVQAWPFTCLPLVSLMKTLHLEPLKALLEGLHMLLTQKDRPRRWKLQVLDLRDVDENFWARWPGAWALSCFPEAMSKRQTAEDCPRTGEHQPLKVFIDICLKEIPQDECLRYLFQWVYQRRGLVHLCCSKLVNYLTPIKYLRKSLKIIYINSIGELEIHNTCWPHLIRKLYCYLKEMKTLCKLVFSRCHHYTSDNELEGWLVTRFTSVFLRLEHLQLLKIKLITFFSGHLEQLIRCLQNPLENLELTCGNLLEEDLKCLSQFPSLGYLKHLNLSYVLLFRISLEPLGALLEKIAASLETLVLEGCQIHYSQLSAILPGLSCCSQLTTFYFGSNCMSIDALKDLLRHTSGLSKLSLETYPAPEESLNSLVRVNWEIFTPLRAELMCTLREFRQPKRIFIGPTPCPSCGSSPSEELELHLCC

SEQ ID NO: 873875 - protein, 185 aa, Homo sapiens
HRSSFPGEQQARQLPQQLCHHPSMAWGLPCHQNTAGANPHLFLGCYSTSSLQGLEYGGQRGDAHGKPGVLHGELEPHDHTSRLERHDLHSQLPTSVQVRHHWWEGALDLAKKRQQQTSINVFTTIKQGSRCDRWMVLGAISLLYNQEEAPDDRPLRARREVRSQHLSWAFPGTAGPGLVCAGDSQ

SEQ ID NO: 873876 - protein, 38 aa, Homo sapiens
MRNDPMILVNFPSLLPATHACSTLCSLEKVLHREDGNK

SEQ ID NO: 873877 - protein, 145 aa, Homo sapiens
LLCLPKQAWAMAGAPPPALLRPCSLISDCCASNQRDSVGVGPSYPGARYNLAGAPFFKPVRKRNIRVGETRFSSEMNPVPQMEMQKSPGLLASLTLGAVDRSCCYSAILAPLLHCKNGLIRYVKTKGMSASQDECVYQKLSSAGL

SEQ ID NO: 873878 - protein, 90 aa, Homo sapiens; identical to SEQ ID NO: 776589

SEQ ID NO: 873879 - protein, 103 aa, Homo sapiens
GSVAQAGMQWAEVGSLQPPPPDLKPSSHLSLSSSWNYSGTTGGQHHTQLIFVIFCRDGVSPCCPGWSQTPELKQSAHLSLSKCWHYRHEPPCLAWEALLTEVM

SEQ ID NO: 873880 - protein, 108 aa, Homo sapiens
MCSLNTIVDAKQMVFLNTVHLPLCQLDLNFDTMCFTYRRRKENIICDCHMTRQLWVFWEKKAVLAVRESAGNVHQRNSSVTLRAEIGKPVPFLYFCSFFSTHSKLPPG

SEQ ID NO: 873881 - protein, 182 aa, Homo sapiens [sequence omitted]

SEQ ID NO: 873882 - protein, 1087 aa, Homo sapiens
EESSLEHPKFKSSGNAVIYSVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 873883 - protein, 1003 aa, Homo sapiens
EESSLEHPKFKSSGNAVIYSVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRYVVVTDFDFRGYRYFL

SEQ ID NO: 873884 - protein, 1239 aa, Homo sapiens
MFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 873885 - protein, 70 aa, Homo sapiens
LVVTGPMGYAPDIAFAYSVKSRDRKMVGDVTGAQAYASTAKCLNIWALILGILMTILLIVIPVLIFQAYG

SEQ ID NO: 873886 - protein, 244 aa, Homo sapiens
MGSPRSALSCLLLHLLVLCLQAQEGPGRGPALGRELASLFRAGREPQGVSQQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 873887 - protein, 204 aa, Homo sapiens
MGSPRSALSCLLLHLLVLCLQAQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 873888 - protein, 215 aa, Homo sapiens
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 873889 - protein, 233 aa, Homo sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 873890 - protein, 259 aa, Homo sapiens
RRGEHDVPRDPRSRVVIAAGLPHPHPLRSRPAQRVLPRRPAGRRDPPGSRCPGAARHGQPPLRAELPVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 873891 - protein, 111 aa, Homo sapiens
GQQMSHENDPYILHSLIRRVTTVTISCSCNTSCFMFILIKEELGLKQWLMPVILALWEAEAGRSIELRNLRLARQHGETPSLLKKNTKKWPGTVAHTCNPNTLGGRGRRIT

SEQ ID NO: 873892 - protein, 109 aa, Homo sapiens
LRRRVPNKRSTTLRSGEVLLGPTKATQVKEWMALPQLWLRSPLQDDILLGDGHQRQGHGRRCQEEAQRKGYGSTKQESGLLQARKRGLPRNQLYQHIDLGLLASRTLRK

SEQ ID NO: 873893 - protein, 531 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPRPPTPPCAVTKTLSASHRTCYLVTQL

SEQ ID NO: 873894 - protein, 549 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPSTLLCSEDLPPLPVPSPRLSPPPTAPATLSHSSRPAVCVLGAPP

SEQ ID NO: 873895 - protein, 248 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPP

SEQ ID NO: 873896 - protein, 557 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQVPFRVPPHLLLQAHTTSDPKPSAPQTCLGASPQLASHALREASLTLSPQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLVTAPLLEPLPAPRVLGPTPEA

SEQ ID NO: 873897 - protein, 386 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQVPFRVPPHLLLQAHTTSDPKPSAPQTCLGASPQLASHALREASLTLSPHSRPRGGPAAASDIRVFASNCSMHGLGTSSGQAALSLRRGMWAAAVVLSVATFLYQVAERVRYYREF

SEQ ID NO: 873898 - protein, 126 aa, Homo sapiens
QSAGSTGVSHRARPLPGFLKGVGEPTAASCQQWAPGGGQPTFEAILVLRENVLALDIFFEALNYETVEQKKAYEMSELLGVCAGPPGLGGCGQAGGCKLKGDPVSTGDIGGQMGLFIGASLLTILE

SEQ ID NO: 873899 - protein, 415 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLALEAQPQRGLHRGERAGPGHLL

SEQ ID NO: 873900 - protein, 413 aa, Homo sapiens
DGHHPVCPPQIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQVPFRVPPHLLLQAHTTSDPKPSAPQTCLGASPQLASHALREASLTLSPQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPRPPTPPCAVTKTLSASHRTCYLVTQL

SEQ ID NO: 873901 - protein, 321 aa, Homo sapiens [sequence omitted]

SEQ ID NO: 873902 - protein, 117 aa, Homo sapiens
KQRSGCCWRKDKFSVVSRLLHKYKARCCCYWKRSEKKLLMFKTTWTRLLNYERQFCCCVGKDKNTENRLSPHSLRLRVKETNRSLNPRDNLIEAEAYQFPGVNAVYFSLRCSFAYNT

SEQ ID NO: 873903 - protein, 218 aa, Homo sapiens
GRGRGRGWGRGQDRGVRGGKAQDKERMPVTKLDGLAKDMKIKSLEEIYLFSLPIKESEIIDFFLGASLKDEVLKIMPVRKETRAGQRTRFKAFVAIRDYNGYAGRVKCSKEVAAAIRGAIILTKLSIVTVRRGYWGNKIGKLHTVPCKVTGRCGSVLVPFIPAPRGTGIVSAPVPKKLLMIAGIYDCYTSARGCTATLGNFANATLDAVSNIYSYLIP

SEQ ID NO: 873904 - protein, 117 aa, Homo sapiens
WARESLEAHVAANPAAPVHLPPCLPAFSAELRPGVKEEPSPGAPKKAEEGAFYLASVTPPGPSRLDKTLQRQCLALISPVTPVKVYCCLFIIAVLTTSVIALSIVLSEFPEKIQRPF

SEQ ID NO: 873905 - protein, 115 aa, Homo sapiens [sequence omitted]

SEQ ID NO: 873906 - protein, 104 aa, Homo sapiens
MLMPTINMNIKWSNCRKSEKEKTNKETETESGNENSGYNSDEQKTTDTASLPPKSCESSDPEQRNSSCGPPHQRADQRPPRPASHPQASFNLASPEKVSNTTVV

SEQ ID NO: 873907 - protein, 198 aa, Homo sapiens
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 873908 - protein, 105 aa, Homo sapiens
MFKVIQRSVGPASLSLLTFKVYAAPKKDSPPKNSVKVDELSLYSVPEGQSKYVEEARSQLEESIFNRHSRTKPFNLGPGKWSPNFKPKPKNPLVGLVPGKRYSQI

SEQ ID NO: 873909 - protein, 188 aa, Homo sapiens
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKL

SEQ ID NO: 873910 - protein, 110 aa, Homo sapiens
MQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 873911 - protein, 198 aa, Homo sapiens; identical to SEQ ID NO: 873907

SEQ ID NO: 873912 - protein, 114 aa, Homo sapiens
MFKVIQRSVGPASLSLLTFKVYAAPKKDSPPKNSVKVDELSLYSVPEGQSKYVEEARSQLEESISQLRHYCEPYTTWCQTAMTISKMHLLDFFRDLVLLVLLALLDSFWLEVQK

SEQ ID NO: 873913 - protein, 198 aa, Homo sapiens; identical to SEQ ID NO: 873907

SEQ ID NO: 873914 - protein, 110 aa, Homo sapiens; identical to SEQ ID NO: 873910

SEQ ID NO: 873915 - protein, 110 aa, Homo sapiens
RNIAAHDHAPIPLTSKAAFSLPPPAFRACATPVVPGLPSSLRTPSHTRLSLPASRSPEPRRLCSLSCSLSVAPSSSRGKWETLAGASSSRRSEEKERPSRKGRRCGTRGS

SEQ ID NO: 873916 - protein, 103 aa, Homo sapiens
DPFESTVLSSGCSIFSPDGTEMHISDNTAEVTIVPFSVHHMGRYMVSVCLISGDVNLITGLRWFLSGLFTIMTVFPFVIVSEYILYNCESWSHSNVSHAPQNN

SEQ ID NO: 873917 - protein, 77 aa, Homo sapiens
ATAISHNPETKKTRVKLPSGSKKVVSSANRAVVGVVAGGGRTDKPILKACQAYHKYKAKRNWWPRVWDVAMNPMEHP

SEQ ID NO: 873918 - protein, 561 aa, Homo sapiens
MPGPRAACSEPNPCTQVVMNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQAQKLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 873919 - protein, 80 aa, Homo sapiens
MVDNGADDWRIAMTCERVFLISLELAVCAIHPVPGHYRFTWTARLAFTYAPSVAEADVDVLLSIPMFLRLYLLGRVMLLH

SEQ ID NO: 873920 - protein, 120 aa, Homo sapiens
FSCFSSSSSTSSSSLLPFLSFFSDLFVQESLTRRLNVNKRLKTELLCWRWGGEPEDFFICLSPHPPSWHLKNSAETSFQGLCGQSVHVQACMPVCRWYGEKGDCIVHKNVTCSSIRPLSF

SEQ ID NO: 873921 - protein, 383 aa, Homo sapiens
WGFSARGRGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGKLPR

SEQ ID NO: 873922 - protein, 371 aa, Homo sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGKLPR

SEQ ID NO: 873923 - protein, 315 aa, Homo sapiens
MDKADTRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGKLP

SEQ ID NO: 873924 - protein, 382 aa, Homo sapiens
DIATRRSGTGKMAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGKLPR

SEQ ID NO: 873925 - protein, 385 aa, Homo sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDNSFKQKHTSKAPQRVCGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGKLPR

SEQ ID NO: 873926 - protein, 270 aa, Homo sapiens
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGVFQRHHCERGAGVPHECGHVPWVRAVAAGYPRGPRSDEPISAR

SEQ ID NO: 873927 - protein, 184 aa, Homo sapiens
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDGVFQRHHCERGAGVPHECGHVPWVRAVAAGYPRGPRSDEPISAR

SEQ ID NO: 873928 - protein, 157 aa, Homo sapiens
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDGGEHRMTTVFPGPHLCM

SEQ ID NO: 873929 - protein, 39 aa, Homo sapiens
TTEQVRALEGVFRHHQYLGPLERNWLAREMQLSEVQIKT

SEQ ID NO: 873930 - protein, 184 aa, Homo sapiens
GEERGWGVSPVLGLTQGGVQGSQEHHKQGSRRTDGGSTASLGGEIKGWQGRWPGKNLHGKDFPAPGLGYASMVIVFYCNTYYIMVLAWGFYYLVKSFTTTLPWATCGHTWNTPDCVEIFRHEDCASASLANLTCDQLADRRSPVIEFWENKVLRLSGGLEVPGALNWEVTLCLLACWVLVYFCV

SEQ ID NO: 873931 - protein, 276 aa, Homo sapiens
GCERPTAPTVAVRAPGQKQTDTAPAVDSDPARMPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPGTMQHIDYQLETCPEPRYTATQHP

SEQ ID NO: 873932 - protein, 127 aa, Homo sapiens
GCERPTAPTVAVRAPGQKQTDTAPAVDSDPARMPPTQAESVIRSIIREIGQECAAHGEIVSETLIAFMVKAVVLDPSNGFNMDRTLMKSDVQNLVKLCMTRLLDTKNPSLDTIKMQVYFDMNYTNRA

SEQ ID NO: 873933 - protein, 298 aa, Homo sapiens
GCERPTAPTVAVRAPGQKQTDTAPAVDSDPARMPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDFRYNYWCSRSGNDDKTVRSPSGTTKNDHKIKDSGPNITSLSYLHCTFYSVDQLARR

SEQ ID NO: 873934 - protein, 134 aa, Homo sapiens
PSLLNCLQFLSCKLTFALLCSYREMCNLFVKHSNKAYLGFLTCVFSLRPSLVQSGLNTVTEQRDLFFQWCTVSWVQLAGAGVVDGKRIYRQGVVAHACNPSTLGGQGGQITGGQEFVTSLAKVVKPHLYQKYKN

SEQ ID NO: 873935 - protein, 44 aa, Homo sapiens
RHRHAKGYQQRLRPEAEMPGMRIWKINTIELSTVAFFFFLGLRK

SEQ ID NO: 873936 - protein, 120 aa, Homo sapiens
RALRGEAGPNPCVGFVVGPARRCGRPPGMANWVFCNRCFQPPHRTSCFSLTNCGHVYCDACLGKGKKNECLICKAPCRTVLLSKHTDADIQAFFMSIDSLCKKYSRETSQVSCEGCGLVP

SEQ ID NO: 873937 - protein, 132 aa, Homo sapiens
TRPLLLPRLFFLLLSPWPRPRRSSDPLAPPRPLDAQLPHLPWPHAVATCCLKTPGETFRASVLACHVVNQISLIARSTPLLSVRLRNHLQAMAGDVPASHREDYAGEPHGQAGLWLQQLWGLHVPALALLQQ

SEQ ID NO: 873938 - protein, 480 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQKWWCAGNASGRTGMDRGEAGEEGGNHPNTHQLLSVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873939 - protein, 453 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPTVPCRSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873940 - protein, 227 aa, Homo sapiens
MAMAACPAPLFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873941 - protein, 410 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQTDEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873942 - protein, 401 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873943 - protein, 210 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 873944 - protein, 405 aa, Homo sapiens
MALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873945 - protein, 128 aa, Homo sapiens
MVLGPVAQQSSWPRCCAHTLARVPSRLASHDAAAGPAALRRDGRGPSAALEGVRAHAGAARGRDRSRGGGDRPLPRPAVRDAQALAPAAARGPRSRLRGPGAHGAGRLRGRLAQPPAARPVTRRPLAT

SEQ ID NO: 873946 - protein, 264 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873947 - protein, 446 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873948 - protein, 487 aa, Homo sapiens
GPCGRGAEGGTTTGREHGAGKPLGARRRAMEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRSRWCAGNASGRTGMDRGEAGEEGGNHPNTHQLLSVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873949 - protein, 176 aa, Homo sapiens
SAGCAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 873950 - protein, 191 aa, Homo sapiens
MAMAACPAPPDEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873951 - protein, 218 aa, Homo sapiens [sequence omitted]

SEQ ID NO: 873952 - protein, 191 aa, Homo sapiens; identical to SEQ ID NO: 873950

SEQ ID NO: 873953 - protein, 412 aa, Homo sapiens
SAGCAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 873954 - protein, 217 aa, Homo sapiens
MVQKYQSPVRVYKYPFELIMAAYERRFPTCPLIPMFVGSDTVNEFKSEDGAIHVIAKALQAGCRCTQTAEEDCRSSDYVHFVQKNSLNSRERTLHIEAYNETFSNRVIINEHCCYTVQPENEDWNCIEQSAQFSILNLSLVFESTVAKNCNETDITATSTTGKEIIRNTTIAKRTKKAYTFVPRRRAAYQSRPSSKESQHPPEHSRLKGRRIQKMAQ

SEQ ID NO: 873955 - protein, 150 aa, Homo sapiens
MNTLQGPVSFKDVAVDFTQEEWQQLDPDEKIAYGDVMLENYSHLVSVGYDYHQAKHHHGVEVKEVEQGEEPWIMEGEFPCQHSPGSSAGAGSGEFHVYRHLRRREYQRRTTWMPWVRSKNGCRVSEKMEKNKLCRGADRSAEEAQKLKEK

SEQ ID NO: 873956 - protein, 122 aa, Homo sapiens
SPLGIRPLRKTERTRSFRPKLFGIHSFSTDFLKTVFLLPRGPCSQSSQDGGGPLPRRWWAASKMAEATSKMVASLMFSDLGFLASRIPRNGILGHAVSVIALLETMGHRREPWNPVTSVQLD

SEQ ID NO: 873957 - protein, 104 aa, Homo sapiens
LDTPTAPPPPPPALALKFLCVVRLKGIPSCLRLRRLPARVWSASNSGWSGCCAGQRPAVRRKMCSKVFKGHEEVGHPSESLRLQISVPYTIVDCEKTCCSRHEG

SEQ ID NO: 873958 - protein, 160 aa, Homo sapiens
MTTQEDTTGLHQKTSLWTMSRPGAKKVMNSYFIAGCGPAVCYYAVSWLRQGFSINLTSFGRIPWPHAGVGTCPSPQSWISPFLQSHREHHYAKTSSHSQPSPQSLALCLAYSRCSINICQMTECISLASGCHQALREPGRSEESFWIPATPYISNIFSES

SEQ ID NO: 873959 - protein, 661 aa, Homo sapiens
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 873960 - protein, 661 aa, Homo sapiens; identical to SEQ ID NO: 873959

SEQ ID NO: 873961 - protein, 102 aa, Homo sapiens
MSCLGRMDVLGPTQDLVLLSSSSYLCLAHSLAHDVGSVMCEKVKMPLSPPHFTEENTKAQRKLRESQWAEPGLGPGGVWSTQADPVLVGITPTGATARNTPP

SEQ ID NO: 873962 - protein, 661 aa, Homo sapiens; identical to SEQ ID NO: 873959

SEQ ID NO: 873963 - protein, 661 aa, Homo sapiens; identical to SEQ ID NO: 873959

SEQ ID NO: 873964 - protein, 129 aa, Homo sapiens [sequence omitted]

SEQ ID NO: 873965 - protein, 134 aa, Homo sapiens
LNKVISELNGKNIEDAIAKPHPDDPHPSYHGVMSCLGRMDVLGPTQDLVLLSSSSYLCLAHSLAHDVGSVMCEKVKMPLSPPHFTEENTKAQRKLRESQWAEPGLGPGGVWSTQADPVLVGITPTGATARNTPP

SEQ ID NO: 873966 - protein, 359 aa, Homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 873967 - protein, 116 aa, Homo sapiens
MAETSALPTGFGELEVLAVGMVLLVEDPGAADSLPPTGAELGSCGQWDQPECPRCSHIQPSPALALRLGRLPGSRLPGLCDSVGQHLQQCSHRMGALSPLLHPPKCCHRSHHFEWR

SEQ ID NO: 873968 - protein, 253 aa, Homo sapiens
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVPALIAKMVPTINAINYALGNEMVCRGIWQCLSPQKREKDRTK

SEQ ID NO: 873969 - protein, 81 aa, Homo sapiens
RMAETSALPTGFGELEVLAVGMVLLVEGEPGRTWGAAGAQWVLRTQATSVELARRGEVPKPSWVSGPIGCLPLCARTRGVF

SEQ ID NO: 873970 - protein, 291 aa, Homo sapiens
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVPALIAKMVPTINAINYALGNEMVCRGIWQCLSPQKREKDRTK

SEQ ID NO: 873971 - protein, 109 aa, Homo sapiens
MAETSALPTGFGELEVLAVGMVLLVEDPGAADSLPPTGAELGSCGQWDQPECPRCSHIQPSPVPAPSPVHRLWGPAWGLTPGPWAARPRAFLLLTENWPRAEGGQAKMG

SEQ ID NO: 873972 - protein, 275 aa, Homo sapiens
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVQILLVPKTRPLSIFVLCLISSHFLDL

SEQ ID NO: 873973 - protein, 313 aa, Homo sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 873974 - protein, 280 aa, Homo sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTQEMKSLAGCTVAHACNPSTLGGQGQRIT

SEQ ID NO: 873975 - protein, 305 aa, Homo sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALSPGLECSCAFLAHCNLHLLGLSDSHASGSQVAGIEGMCHHAQLIFVFFVETRFHHDGQAGLKFPASSDPPPQLPKVLGLQA

SEQ ID NO: 873976 - protein, 313 aa, Homo sapiens; identical to SEQ ID NO: 873973

SEQ ID NO: 873977 - protein, 305 aa, Homo sapiens; identical to SEQ ID NO: 873975

SEQ ID NO: 873978 - protein, 474 aa, Homo sapiens
MQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 873979 - protein, 83 aa, Homo sapiens
ARRQRAAKGGDCHFCYPRPTFLILRFDLPGFVFQLRKIKESLLPYFSFSSNTEPHVYLPGLIILLLFASVALVAAIIFGVCYR

SEQ ID NO: 873980 - protein, 616 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 873981 - protein, 598 aa, Homo sapiens
PQVVLPEVWLSISAAPVKATVHGARTLSSFWGGEGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 873982 - protein, 90 aa, Homo sapiens
PKVDMVNEEIGKQQKVAVIHQMKEDQSKIPEGIQVDSDGLITITTPNKLATLSVRAMPLPEEVTQILEENSDLIRSMEQLTSSLNEGENT

SEQ ID NO: 873983 - protein, 109 aa, Homo sapiens
MNTLQGPVSFKDVAVDFTQEEWRQLDPDEKIAYGDVMLENYSHLVSVGYDYHQAKHHHGVEVKEVEQGEEPWIMEGEFPCQHSPVQNLLRPSNLLIGSQSIRFALGQWY

SEQ ID NO: 873984 - protein, 109 aa, Homo sapiens; identical to SEQ ID NO: 873983

SEQ ID NO: 873985 - protein, 109 aa, Homo sapiens; identical to SEQ ID NO: 873983

SEQ ID NO: 873986 - protein, 109 aa, Homo sapiens; identical to SEQ ID NO: 873983

SEQ ID NO: 873987 - protein, 162 aa, Homo sapiens
ASLDHGLQPERLGGSRVSQGSVGGGEAGAAGVGTWRLLKRTRAGGRCARHPCHVAEEPGARGPWQGAGRTQATPTSGSHPVAGEGPRPLEGPTWRVVQRGVGHPQIRGKLGSTLSFPRVEVTTIISGEPVPLRKETLREIRWRGSGFRGAPSPSLKRWSPGK

SEQ ID NO: 873988 - protein, 648 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 873989 - protein, 648 aa, Homo sapiens; identical to SEQ ID NO: 873988

SEQ ID NO: 873990 - protein, 350 aa, Homo sapiens
ESPSHTGSLHTGQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 873991 - protein, 648 aa, Homo sapiens; identical to SEQ ID NO: 873988

SEQ ID NO: 873992 - protein, 648 aa, Homo sapiens; identical to SEQ ID NO: 873988

SEQ ID NO: 873993 - protein, 648 aa, Homo sapiens; identical to SEQ ID NO: 873988

SEQ ID NO: 873994 - protein, 648 aa, Homo sapiens; identical to SEQ ID NO: 873988

SEQ ID NO: 873995 - protein, 638 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKLNNTTKQ

SEQ ID NO: 873996 - protein, 550 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQNFLPVFPFLPFSLP

SEQ ID NO: 873997 - protein, 607 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKTMTDVVGNPEEERRAEFYFQPWAQEAVCRYFYSKVQQRRQELEQALGIRNT

SEQ ID NO: 873998 - protein, 607 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 873999 - protein, 568 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 874000 - protein, 183 aa, Homo sapiens
RLRSSRGVVGRGNIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 874001 - protein, 556 aa, Homo sapiens
FGKLTPCAKMKLLLQAPLHQRARVGVETGAEAVVRPPFQVLVFLPSAWGRPLTRPLYCRALLYGFPSRTVKAGGRGQHAFSASRPALSHSLAALSLPCRPAGRGNRRALGGRSGGGGSSGSGSLCGCIGGSGKMAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQLENSAELGL

SEQ ID NO: 874002 - protein, 550 aa, Homo sapiens; identical to SEQ ID NO: 873996

SEQ ID NO: 874003 - protein, 113 aa, Homo sapiens
NSPASASWIARITGLHHHARQIFVFLVETGFHHVGQAGLELLTLSDPPTLASQSAGITGMSHREAGAIKDHLKRMQGEANNQEQISKRETESHQKSVRKPGIQGELDSKYNNT

SEQ ID NO: 874004 - protein, 268 aa, Homo sapiens
MCGISHGLRCLSVIVLRELVAWFIKLFFIFSIQDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRWYFWHMKLSQFKCESTPKEYHFSLCFNLSVAQAEGN

SEQ ID NO: 874005 - protein, 696 aa, Homo sapiens
MGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874006 - protein, 678 aa, Homo sapiens
MGVLDIYGFEIFEDNSFEQFIINYCNEKLQQIFIELTLKEEQEEYIREDIEWTHIDYFNNAIICDLIENNTNGILAMLDEECLRPGTVTDETFLECSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874007 - protein, 946 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874008 - protein, 993 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874009 - protein, 964 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874010 - protein, 233 aa, Homo sapiens
VRSKISVWVRRSKQNVACQCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874011 - protein, 964 aa, Homo sapiens; identical to SEQ ID NO: 874009

SEQ ID NO: 874012 - protein, 941 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEYVHVLFENPFSLSAFLF

SEQ ID NO: 874013 - protein, 908 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEVPGTVQTGQSMCEVYSGKPEKWECPNM

SEQ ID NO: 874014 - protein, 937 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMVANPRIGDHFNKQFSQGKSLQLIIQFIFRAKLMGSY

SEQ ID NO: 874015 - protein, 167 aa, Homo sapiens
GLATISISTINLPSTLIVFTILILLTILEMVANPAVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMVANPRIGDHFKLFNWQY

SEQ ID NO: 874016 - protein, 867 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKCRREPPRPACSVEFKLVHIEVRIEFIQRFSCLIVSSP

SEQ ID NO: 874017 - protein, 857 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVCRREPPRPACSVEFKLVHIEVRIEFIQRFSCLIVSSP

SEQ ID NO: 874018 - protein, 520 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCINPMIAFGGPSMLRQANALSRLMTWLEGSNAWKPWLIVA

SEQ ID NO: 874019 - protein, 269 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKVLNFYEQNQL

SEQ ID NO: 874020 - protein, 269 aa, Homo sapiens; identical to SEQ ID NO: 874019

SEQ ID NO: 874021 - protein, 964 aa, Homo sapiens; identical to SEQ ID NO: 874009

SEQ ID NO: 874022 - protein, 964 aa, Homo sapiens; identical to SEQ ID NO: 874009

SEQ ID NO: 874023 - protein, 716 aa, Homo sapiens
MCGISHGLRCLSVIVLRELVAWFIKLFFIFSIQDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874024 - protein, 964 aa, Homo sapiens; identical to SEQ ID NO: 874009

SEQ ID NO: 874025 - protein, 381 aa, Homo sapiens
MKKSQIVIAAWYRRYAQQKRYQQTKSSALVIQSYIRGWKARKILRELKHQKRCKEAVTTIAAYWHGTQARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874026 - protein, 218 aa, Homo sapiens
MISLCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874027 - protein, 944 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVNIIRNPVV

SEQ ID NO: 874028 - protein, 954 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGRPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMVANPRIGDHFKLFNWQYLEPYCSDLILNTILYLLSEELVFTLFHNFINECKMM

SEQ ID NO: 874029 - protein, 98 aa, Homo sapiens
WGLEGALQAMNVGKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 874030 - protein, 269 aa, Homo sapiens; identical to SEQ ID NO: 874019

SEQ ID NO: 874031 - protein, 684 aa, Homo sapiens
KNRGQYACHVLCGSWLWKRSKVNQVRTALQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQHEGN

SEQ ID NO: 874032 - protein, 496 aa, Homo sapiens
GKIEDSTLVMSYVAAGCGKGAKLIKKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMSRHISTSSVHSGPLRTSIGYASAAMTC

SEQ ID NO: 874033 - protein, 269 aa, Homo sapiens; identical to SEQ ID NO: 874019

SEQ ID NO: 874034 - protein, 84 aa, Homo sapiens
FIKKRNLFLTVLQAGKPKVEGLPLVTYGEDLVLFPNTARNHAKRKMLQHSLAVDQAAHREQVHSWGLTPPFREAWLHLHSLVAS

SEQ ID NO: 874035 - protein, 2989 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKTDRCLIASPEEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVFLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEHKAEAIGHDIPKLEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKLINKEINKVDTAIDDNIDLKDNMNNFRPIHFKKNITALTLTQEEIENPNSLITLKEIESVIKITNKTSGPVSEFTELSKYKFPIEMLSELIYKASITWISKPDENSAVHSCKKSRQVIGKPDLNVYAKMIMFDLPQEMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874036 - protein, 3015 aa, Homo sapiens
LELKMLYFSRSHFPRPCGGQVSAGSGLTLLLLLLPALWRGWLEGDGQQAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRYQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVCPGHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLGKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNSFTRLAEPGYPNLMRIVQCTAAKSLDKLLVNQICIVRKDDYVGFTPGMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874037 - protein, 2943 aa, Homo sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVFLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNYLIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNSFTRLAEPGYPNLMRIVQCTAAKSLDKLLVNQICIVRKDDYVGFTPGMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874038 - protein, 2924 aa, Homo sapiens
PAPPDGVGSADTEDRKLPAPGADVKVHRARKTMPKSVVGLHAASKDPREDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVVLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNGSCLFKLQGTYSEGACMLPLSPREAARAPGKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSELIYKASITWISKPDENSAVHSCKKSRQVIGKPDLNVYAKMIMFDLPQEMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874039 - protein, 1535 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAAAPYETPPASGALGSQGPPRRRLEDEEERFRTQPKGSFGAAAAGFLEGSEVRLQPLRAGVDASQPPSQTCGLTAGPVPRLERTLWSARQRRWESALASPSEFLMLICRCKFLVSSSDLRGPRCTTGLLCSPVRPRLFCVAPPKPPLARAAPFALPTACVAGAESQGRTEGTVSCQARRGQETDPTTNFGENVGLLFKGILYLVLYIKPLTDVSFRGSGLVGAAPAGSVDAGTFC

SEQ ID NO: 874040 - protein, 2942 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHEGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYTRFSISRGSGDNWAEEDCDLSAREGRVSWTMKKGRLSSFSALSVAFPWSHQSDSFPSLGLRSMDTMKEAEPVTGTLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLGKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEHKKLRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSEFTELSKYKFPIEMLSELIYKASITWISKPDENSAVHSCKKSRQVIGKPDLNVYAKMIMFDLPQEMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874041 - protein, 815 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQFCRLGSPRSRGCLW

SEQ ID NO: 874042 - protein, 432 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLLVLLFFLLI

SEQ ID NO: 874043 - protein, 93 aa, Homo sapiens
MECQPESSISHRFHKDCASRVNNASYCPHCGEESSKAKEVTIAKADTTSTVTPVPGQEKGSALEGRADTTTGRYLAQALAGLSSRPPEKVSVV

SEQ ID NO: 874044 - protein, 858 aa, Homo sapiens
GSREGRGHAAGPGHGRRRCAGPGHGRRRCRETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKIQKTSKVYTESQETQRSQTIL

SEQ ID NO: 874045 - protein, 2995 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRYQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVCPGHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLGKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNSFTRLAEPGYPNLMRIVQCTAAKSLDKLLVNQICIVRKDDYVGFTPGMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874046 - protein, 2975 aa, Homo sapiens
GSREGRGHAAGPGHGRRRCAGPGHGRRRCRETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSALQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLEATDGLVELARRPWSLWPVREAGTSEGVQQFSSIHPSSHEAWQRGGRGGGPAVDPTSLSRSWDLECKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVVLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWECPRSLNNLRKVQESCQGVLEPKKCGLSTNAETDSEHKAEAIGHDIPKLEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNSFTRLAEPGYPNLMRIVQCTAAKSLDKLLVNQICIVRKDDYVGFTPGMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874047 - protein, 2962 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVCLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNSFTRLAEPGYPNLMRIVQCTAAKSLDKLLVNQICIVRKDDYVGFTPGMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874048 - protein, 3005 aa, Homo sapiens
WFSGGAGPRCGPGPWPPPMRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSPKKKNFFFWGKKKKKAPLLAPEFVPQGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVVLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEHKAEAIGHDIPKLEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDDNIDLKDNMNNFRPIHFKKNITALTLTQEEIENPNSLITLKEIESVIKITNKTSGPVSESTELSKYKFPIEMLSNFIYKASITWISKPDENSAVHSCKKSRQVIGKPDLNVYAKMIMFDLPQEMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874049 - protein, 2690 aa, Homo sapiens
MGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSAEQLKLTLPDRIPKEAPWIITDAELRVTLMVEGENVQKQMNPQVWNSGEDSGLSYGSGNSWTEQWFQAGDDFAPGGRLQGLETVWVVTTEGVLWHLVGSGRDVVKHCTVHRTALPNRVPGPYMLMVLGLRGHCWTRGAGEAALESVACEEKREPLRECSVQQHPPIQPRGLAEGWERRWTCRRPHKPVKELGLGGKGERRGQNCALERPLWTQRGGWGEARAAWCCGCLLEWQARPLWAAVREGVIRELEEAGQGNGLDLMGEEKLVTFGMQQTVLMPCHQHHARAGWALTLTECPMNNYVTKSAVCCRKQLTGAGGVGSKKNLPRLLEVKKGRFMRESRKIRCKKAMGNHQERRWQQELKACWGFYRMGLVPERAMCSADNAQVAGSYRVFLSAEDLVITGRRKIVICLHGRAVVLDHEERQTHSFSALSVAFPWSHQSDSFPSLGLRSMDTMKGGRACDRKLSQGGFSDEGQSCPGQAWGDRRTFTFKVLFEHGFNESSQCFEIDNLVSVVYKTFAPPEQHPLYVVIITNYILTHWATSRTYNYCNRQLSLEIARHLQRRCLHAPSSPPGKQPEPLEKGQVLTCQTSQLIPGSQPLFRQWIPILKIGSCPETARECDFLLGQPLSPCPLLTLTCEASPLLATGFTPQGTVLCYHPLLLPPGPSVAACLIFPTGIREPGSVAASPIISTGCRGGTPRLSHPQHRLQMGNPSTLPPSAQAADGEPLDSPTLSTGCRGGTPRLSHPQHRLQTGNPSTLPPSAQAADGEPLDSPTLSTGCSGECLDFLVMLVFSLGLPAHPPPSTPFLPLPAVRELEGFCFTVSWLPLFSRLLRAIPSFPHLLGPEKVPHCSKCFQTLVKLLTLPSRDFSSAPAEAINQFLQLLSCAAPFSLFRLSTLPLPVGLCWDLALAIGLAGRWDSSWGEHLLPGETGDFRNISSTVDVLTFMGQEDLCTSRGSRGLEGPHRYIFGTQIFPRGPLLSTFAELTHRWPFTLVKCLFTSVVEALQSHTELGNSSQDVGMGNQPAVLSLLVWLLPTPSFSGACIIPPATALCSTEIFSQVITHEAPTVCQGPPDLPANQDSSLCTLWVVGRTVPDPLLMPLMLVQVFQDADGIKVEGFGEILLDDEELSVVARACNPSTLRGQGGQITGTQEFEASLGNMVKHRLNKNKQTKISLAWWCVPVVLATWEAGMGGLLESRRWRLQWAEIMPLYCSLGDGNEALSKKEEKILLDDEDYDIVVIIRDEAWRKLRNLEELQNVSSSNFQRGREGTKVDWEGPRSLNNLRKVQESCQGVLEPKKCGLSTNAETDSEQQELRPLVMTFPELEAYEAHFQGNCNCLKYSNVLCVFFLKERLKVNELIIHPKKQNQPKTRGIKRSTNEIETNMHWRQSNQNWFFGNTNQNGNPLGRWGRGSINKQFKGGPGAVADTCNPSSFGRLRWEDHLSPGVGDQPGQHSKTLSLEENLKTSWTWWHAPVIPATREAEVGGWLEPGRLRLQELRFYHCSPVWVTEQDHVSINKEINKEINKVDTAIDITYDLKDNMNNFRPIHFKKNITALTLTQEEIENPNSLITLKEIESVIKITNKTSGPVSEFPELSKYKFPIEMLSELIYKASITWISKPDENSAVHSCKKSRQVIGKPDLNVYAKMIMFDLPQEMTGWFNFRKSVYVSHSLNTYEGEKLGHFNAEKAFDRIYHLFVEKLLEIKTRGELCDLMNWYLLNKKKKNRPGAVAHACNPSTVGGQGGQITLRSVVQDQHGKTPSLLKVQKLARCGGTRLESQLLRRLRQENCLNLGGGGGCSELR

SEQ ID NO: 874050 - protein, 478 aa, Homo sapiens
MRGAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALAASLTVSTKTVPLESITPAIVPTVGRRAPRPKR

SEQ ID NO: 874051 - protein, 101 aa, Homo sapiens
GFRRGSRWLFMWRMVICECLPAIVTVLSWSLWLHLKSLIKLCLFTVDGIDPNFKMEHQNKRSPLHAAAEAGHVDICHMLVQVRRHGALLGLFTCSLLFLPK

SEQ ID NO: 874052 - protein, 55 aa, Homo sapiens
MRTDPALGYTPARVGEKDLGASSLHVNGESLEMDSDEDDSEELEEDDGHGAEQAA

SEQ ID NO: 874053 - protein, 41 aa, Homo sapiens
MGPTGLFIPSFNNNGLSFPWVLGTMLAIWGQHTETGVLSFW

SEQ ID NO: 874054 - protein, 111 aa, Homo sapiens
GCWQDKAVKKQSVKQQEPGVEKDLQRAGSGSSGGSKKSERQTWNTARAREWGSTGEHAPSSLLPVNLLKDTSASPSSHVGQLLPGVHQHLPVFTTNPQYLKIACIHLCSFN

SEQ ID NO: 874055 - protein, 39 aa, Homo sapiens
MELEFPGQNISTLERRELHRESSRGLQRAPQKSSAGYPS

SEQ ID NO: 874056 - protein, 135 aa, Homo sapiens [sequence omitted]

SEQ ID NO: 874057 - protein, 47 aa, Homo sapiens
MASASSQPSLAVGFSSFDPGAPSCTASSASGILSPTASEVPYASGMP

SEQ ID NO: 874058 - protein, 75 aa, Homo sapiens
PNFLSYSQTLECSPALERTRSSSHSSASVPFHHSPSGLRLPQLQRSDRNLLAGWVREAGDLRLLVADRKEAECRG

SEQ ID NO: 874059 - protein, 292 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 874060 - protein, 292 aa, Homo sapiens; identical to SEQ ID NO: 874059

SEQ ID NO: 874061 - protein, 292 aa, Homo sapiens; identical to SEQ ID NO: 874059

SEQ ID NO: 874062 - protein, 331 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSWCLCSWCPRFWLSYVQEEAHLLRLTFLIIHTHSPAKASPEPNKPVGWETAQT

SEQ ID NO: 874063 - protein, 279 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGS

SEQ ID NO: 874064 - protein, 134 aa, Homo sapiens
LSGPLAGGNQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 874065 - protein, 292 aa, Homo sapiens; identical to SEQ ID NO: 874059

SEQ ID NO: 874066 - protein, 292 aa, Homo sapiens; identical to SEQ ID NO: 874059

SEQ ID NO: 874067 - protein, 292 aa, Homo sapiens; identical to SEQ ID NO: 874059

SEQ ID NO: 874068 - protein, 148 aa, Homo sapiens [sequence omitted]

SEQ ID NO: 874069 - protein, 103 aa, Homo sapiens
KAFITTEEIRKCWRSLVSCVIREGTAGGNRHQYIKQEKLVSRLPKQIEERNERLKEEMLGKLKDLGNLVLRPFGLSTENFQIKQDSSTGSYSINFVQNPNNNR

SEQ ID NO: 874070 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 874071 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 874072 - protein, 198 aa, Homo sapiens
VLQLQSCSPSSCLSANAARMASQNRDPAATSVAAARKGAEPSGGAARGPVGKRLQQELMTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 874073 - protein, 198 aa, Homo sapiens; identical to SEQ ID NO: 874072

SEQ ID NO: 874074 - protein, 169 aa, Homo sapiens
VLQLQSCSPSSCLSANAARMASQNRDPAATSVAAARKGAEPSGGAARGPVGKRLQQELMTLMVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 874075 - protein, 89 aa, Homo sapiens
AVGSIRTSSTVCLLSGPRETQDSSKPLVWGLGWDMRLLLELTLQLFLQMPEPNIDSPLNTHAAELWKNPTAFKKYLQETYSKQVTSQEP

SEQ ID NO: 874076 - protein, 140 aa, Homo sapiens
MTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 874077 - protein, 80 aa, Homo sapiens
NDGLSSDGPQLNDGPQLNDGPQLNDGPQPNDGPQLNDGPLPTPPGWLPKTATQPPLASPPPVKELSRAGAPPGVRWAKGE

SEQ ID NO: 874078 - protein, 98 aa, Homo sapiens
VLQLQSCSPSSCLSANAARMASQNRDPAATSVAAARKGAEPSGGAARGPVGKRLQQELMTLMMSGDKGISAFPESDNLFKWVGTIHGAAGTNPTLIVP

SEQ ID NO: 874079 - protein, 80 aa, Homo sapiens; identical to SEQ ID NO: 874077

SEQ ID NO: 874080 - protein, 149 aa, Homo sapiens
LSDSGKVPTHLKRLSDSGRQKSLYQPDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 874081 - protein, 140 aa, Homo sapiens; identical to SEQ ID NO: 874076

SEQ ID NO: 874082 - protein, 113 aa, Homo sapiens
MEQLEQVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 874083 - protein, 83 aa, Homo sapiens
NDGLSSDGPQLNDGPQLNDGPQLNDGPQPNDGPQLNDGPLPTPPGWLPKTATQPPLASPPPVKELSRAGAPPGVRWAKGYSRS

SEQ ID NO: 874084 - protein, 82 aa, Homo sapiens
TQGNICLDILKEKWSALYDVRTILLSIQSLLGGDFRDHPSPPCNLGTCQDSLGSASSTALTFSFSPPTEPNIDSPLNTHAAE

SEQ ID NO: 874085 - protein, 43 aa, Homo sapiens
RRSRQRSPGGGVSCGALRVEISRLPGQIREEGRELNTEVVAAP

SEQ ID NO: 874086 - protein, 42 aa, Homo sapiens
MFASPWMNEGMAGTHRAAHFTFLTFLPPQSMYKNRVGSTSHE

SEQ ID NO: 874087 - protein, 108 aa, Homo sapiens
LLLLNSRPRRQQAGAEQEPSGVSVHRQPSSGSCTTHPQGPGDSEEAASPCQHACLTHLRACFASLGSRQCLGWGLGQYPLRLGAQLPRTPELSACSHLVKGDFPLPML

SEQ ID NO: 874088 - protein, 488 aa, Homo sapiens
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAHGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRWATP

SEQ ID NO: 874089 - protein, 125 aa, Homo sapiens
ASRMPAVSGPGPLFCLLLLLLDPHSPETGCPPLRRFEYKLSFKGPRLALPGAGIPFWSHHGGEGQGWGPAMPRVPQSAGGAVTWWGVGLSQPSSVQGGARPGTVPGTPGPLPGLSPAPPPQHPPP

SEQ ID NO: 874090 - protein, 527 aa, Homo sapiens
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAHGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFSRQELNKSLQECLSTGSLPLGPAPHTPRALGILRRQPLPASMPA

SEQ ID NO: 874091 - protein, 416 aa, Homo sapiens
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAHGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKHFGRPRRTDHEVKRLTPSGRSQGQKIETILANMVKPCLY

SEQ ID NO: 874092 - protein, 113 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 874093 - protein, 140 aa, Homo sapiens [sequence omitted]

SEQ ID NO: 874094 - protein, 131 aa, Homo sapiens
RNETKDLEPRINTNKVLLYCLFSYIFFSRKPLLSLVNHTGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 874095 - protein, 114 aa, Homo sapiens
YAEQVYLGKRKCLLSPGTLLGLGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 874096 - protein, 103 aa, Homo sapiens
MAAPASRFLLLLLPASAPHRDPGPACVPAGFPVLDANDLEDKNSPFYYDWHSLQVGGLICAGVLCAMGIIIVMSAKCKCKFGQKSGHHPGETPPLITPGSAQS

SEQ ID NO: 874097 - protein, 80 aa, Homo sapiens
HAVGFCAPWAHLRWGSVRHGHHHRHECKMQMQVWPEVRSPSRGDSTSHHPRLSPKLMRTDQLKLGGGPFSVPRSCLCTET

SEQ ID NO: 874098 - protein, 54 aa, Homo sapiens
MQKVTLGLLVFLAGFPVLDANDLEDKNSPFYYGAPYIFVKRMGGQMERTQAGTE

SEQ ID NO: 874099 - protein, 144 aa, Homo sapiens
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 874100 - protein, 107 aa, Homo sapiens
RTKACSTRGNKPGPRLLELAEKGNPWGLAWVPAGFPVLDANDLEDKNSPFYYDWHSLQVGGLICAGVLCAMGIIIVMSAKCKCKFGQKSGHHPGETPPLITPGSAQS

SEQ ID NO: 874101 - protein, 120 aa, Homo sapiens
DVLNYCQTCASFASCDEVPAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 874102 - protein, 144 aa, Homo sapiens
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGQSTQGDSPLITPGSAQS

SEQ ID NO: 874103 - protein, 138 aa, Homo sapiens
ANVHSHSPQSMLIDMESLSPTSTPTAPQSMLVDMESLSPVSSPTAPQSMLIDMESHSPMFISQSPSINVDRHGIIITNVHSHSPSINADRHGIIFTNVNLLLSFLHRLVLQARNLHQKPYCTPPFPLQTPDQFSEMSC

SEQ ID NO: 874104 - protein, 318 aa, Homo sapiens
MNRFGTRLVGATATSSPPPKARSNENLDKIDMSLDDIIKLNRKEGKKQNFPRLNRRLLQQSGAQQFRMRVRWGIQQNSGFGKTSLNHRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 874105 - protein, 318 aa, Homo sapiens; identical to SEQ ID NO: 874104

SEQ ID NO: 874106 - protein, 121 aa, Homo sapiens
MNRFGTRLVGATATSSPPPKARSNENLDKIDMSLDDIIKLNRKEGKKQNFPRLNRRLLQQSGAQQFRMRVRWGIQQNSDTKTLESSIVKHMKRFVLVIPALWEVRARGLLKPRTSGPAWAT

SEQ ID NO: 874107 - protein, 251 aa, Homo sapiens
MRVRWGIQQNSGFGKTSLNHRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 874108 - protein, 318 aa, Homo sapiens; identical to SEQ ID NO: 874104

SEQ ID NO: 874109 - protein, 318 aa, Homo sapiens; identical to SEQ ID NO: 874104

SEQ ID NO: 874110 - protein, 199 aa, Homo sapiens
MNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 874111 - protein, 124 aa, Homo sapiens
MPGKRRPNGVITGLAARKTTGIRKGISPMNRPPLSDKNIEQYFPVLKRKANLLRQNEGQRKPVAVLKRPSQLSRRYSSGNFSFQKRPEGAGPVEYRTTARRCSSKENSSMADFHHKWRDFDCIY

SEQ ID NO: 874112 - protein, 318 aa, Homo sapiens; identical to SEQ ID NO: 874104

SEQ ID NO: 874113 - protein, 314 aa, Homo sapiens
LAAGHRLPSAAGGSGWSRHGCCGRGKTANSSPAAGPAAPGPRLSPRSAEPTRYFLSAYYVPCCASALRTQVDKPELLPDSPGAHHTRRVYVMTQASRGLHEEFIEDAPRTRTPLCAAYLALARDGLPADPKSLRIAAIIGRAHGRAHQTADAASPIHLAKNRNQPDRLLTRLAHTAQRVDAGPSTDAYHQKTRRTYPRTCHEYALVYRTPSPHSGGSARTERTGNPNQITVRITSRTSRAIKPTQHPAAEEGQRTRSRTSTCTKTGPALYGTVHVKGLPRASPREIRKSPLARLQTPTCNTWTIPAVCIYSPDE

SEQ ID NO: 874114 - protein, 802 aa, Homo sapiens
MCSSSPSMQSLSCPPSFLQSHHATTSLGGLRAELPASTPRFRSAAPSLLPVLYGARASFAPPPAVAYSRCQVLGAVRCSALFKITYASSEATVPGHLHHLPQWNASCVKAHNNPCGGTTMSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTIAHEDYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 874115 - protein, 683 aa, Homo sapiens [sequence omitted]

SEQ ID NO: 874116 - protein, 782 aa, Homo sapiens
MCSSSPSMQSLSCPPSFLQSHHATTSLGGLRAELPASTPRFRSAAPSLLPVLYGARASFAPPPAVAYSRCQVLGAVRCSALFKITYASSEATVPGHLHHLPQWNASCVKAHNNPCGGTTMSSESSKKRKPKEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTIAHEDYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 874117 - protein, 344 aa, Homo sapiens
MLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTIAHEDYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 874118 - protein, 171 aa, Homo sapiens
ADLCRDHEYGMTDAHEKYMELHFTKDIVDAGLAGDTNLYYMALIERGTAKLQAAVVLNPGYSSIPPVFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 874119 - protein, 250 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQVGPSGLLLCLHH

SEQ ID NO: 874120 - protein, 683 aa, Homo sapiens [sequence omitted]

SEQ ID NO: 874121 - protein, 683 aa, Homo sapiens [sequence omitted]

SEQ ID NO: 874122 - protein, 683 aa, Homo sapiens [sequence omitted]

SEQ ID NO: 874123 - protein, 683 aa, Homo sapiens [sequence omitted]

SEQ ID NO: 874124 - protein, 344 aa, Homo sapiens; identical to SEQ ID NO: 874117

SEQ ID NO: 874125 - protein, 72 aa, Homo sapiens
ATAYGQACGEYGAWVRTRGYGSSSCGRVNQLEAVPAQEISQSCPKPSGDRSFLPSALPSMAALTSWPKAGLT

SEQ ID NO: 874126 - protein, 122 aa, Homo sapiens
MNENKVRLKRMKTNLFPGSWGLKRSLYGVKPLFLNVLKLTLLQPEASRSALQVPECVGLLPASAPGECGVGVYRCDQGLRDWGAASPQHGLYFPTRSLPLPQLQSSFSITNTGITASIFLEV

SEQ ID NO: 874127 - protein, 586 aa, Homo sapiens
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTETEKKKKEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 874128 - protein, 680 aa, Homo sapiens
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTETEKKKKGEKKVEIMQDRKKSINFKLNLAWPSWDVKLEQEWQRCFLAPQAYLTGMILHCGYLEGKNNPWEFYPGSWNNHKQKWEAEGRGTLILEKIIFFSSEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 874129 - protein, 405 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 874130 - protein, 320 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPDLSL

SEQ ID NO: 874131 - protein, 80 aa, Homo sapiens
VPVGIAGFAAIVAYGLYKLKKQGNTKMSIHLIHMRVAAQGFVVGAMTVGMGYSMYREFWAKPKPEKKRCCLGLVGGACFS

SEQ ID NO: 874132 - protein, 380 aa, Homo sapiens
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 874133 - protein, 380 aa, Homo sapiens; identical to SEQ ID NO: 874132

SEQ ID NO: 874134 - protein, 380 aa, Homo sapiens; identical to SEQ ID NO: 874132

SEQ ID NO: 874135 - protein, 379 aa, Homo sapiens
MERLQKAKMDNQVLGYKDLAAIPKDKAILDIERPDLMIYEPHFTYSIMEKVEMNEKKREIDVKKIKKKKITEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 874136 - protein, 405 aa, Homo sapiens; identical to SEQ ID NO: 874129

SEQ ID NO: 874137 - protein, 405 aa, Homo sapiens; identical to SEQ ID NO: 874129

SEQ ID NO: 874138 - protein, 174 aa, Homo sapiens
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFP

SEQ ID NO: 874139 - protein, 405 aa, Homo sapiens; identical to SEQ ID NO: 874129

SEQ ID NO: 874140 - protein, 144 aa, Homo sapiens
YAVEAVGDRLWHEQTPFETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKGDLDGQGD

SEQ ID NO: 874141 - protein, 380 aa, Homo sapiens; identical to SEQ ID NO: 874132

SEQ ID NO: 874142 - protein, 380 aa, Homo sapiens; identical to SEQ ID NO: 874132

SEQ ID NO: 874143 - protein, 380 aa, Homo sapiens; identical to SEQ ID NO: 874132

SEQ ID NO: 874144 - protein, 248 aa, Homo sapiens
MTPRVGPDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 874145 - protein, 405 aa, Homo sapiens; identical to SEQ ID NO: 874129

SEQ ID NO: 874146 - protein, 77 aa, Homo sapiens
ITTTTTSHRSYQSSVTKTLSQEKSKETMQEGKANTGNSSPKYRGPQTILLIFRGRDTLTTHVHFSKQRTHSLVPEPF

SEQ ID NO: 874147 - protein, 874 aa, Homo sapiens
SIQRWTFAWWPCLILALLSSLAASGFPRSPFRLLGGKVANGIEVYSTKINSKVTSRFAHNVVTMRAVNRADTAKEVSFDVELPKTAFITNFTLTIDGVTYPGNVKEKEVAKKQYAGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 874148 - protein, 854 aa, Homo sapiens
SIQRWTFAWWPCLILALLSSLAASGFPRSPFRLLGGKVANGIEVYSTKINSKVTSRFAHNVVTMRAVNRADTAKEVSFDVELPKTAFITNFTLTIDGVTYPGNVKEKEVAKKQYAGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLSEYMLQKTMPSASTSMKPQAQCCALFRMQSQASQLMGRSLATREAALTPRPERLTLENWASQCSDGLPGGGDNGEDHPVEQGRASTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 874149 - protein, 874 aa, Homo sapiens; identical to SEQ ID NO: 874147

SEQ ID NO: 874150 - protein, 257 aa, Homo sapiens
SSGASQGHLLSSALSPFVSAASYQPPQNPYYYVDGDPHFIIQIPEKDDALCFNIDEAPGTVLRLIQDAVTGLTVNGQITGDKRGSPDSKTRKTYFGKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 874151 - protein, 709 aa, Homo sapiens
SIQRWTFAWWPCLILALLSSLAASGFPRSPFRLLGGKVANGIEVYSTKINSKVTSRFAHNVVTMRAVNRADTAKEVSFDVELPKTAFITNFTLTIDGVTYPGNVKEKEVAKKQYAGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIAMLRWTSRWR

SEQ ID NO: 874152 - protein, 895 aa, Homo sapiens
SIQRWTFAWWPCLILALLSSLAASGFPRSPFRLLGGNGASRKGKVANGIEVYSTKINSKVTSRFAHNVVTMRAVNRADTAKEVSFDVELPKTAFITNFTLTIDGVTYPGNVKEKEVAKKQYEKAVSQGKTAGLVNPGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 874153 - protein, 856 aa, Homo sapiens
SIQRWTFAWWPCLILALLSSLAASGFPRSPFRLLGGKVANGIEVYSTKINSKVTSRFAHNVVTMRAVNRADTAKEVSFDVELPKTAFITNFTLTIDGVTYPGNVKEKEVAKKQYAGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 874154 - protein, 874 aa, Homo sapiens; identical to SEQ ID NO: 874147

SEQ ID NO: 874155 - protein, 874 aa, Homo sapiens; identical to SEQ ID NO: 874147

SEQ ID NO: 874156 - protein, 653 aa, Homo sapiens
SIQRWTFAWWPCLILALLSSLAASGFPRSPFRLLGGKVANGIEVYSTKINSKVTSRFAHNVVTMRAVNRADTAKEVSFDVELPKTAFITNFTLTIDGVTYPGNVKEKEVAKKQYAGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEGMEAGTRRPPVLGTLPGCPVEEWARLGRPRPAEVGHLKENGVWGE

SEQ ID NO: 874157 - protein, 213 aa, Homo sapiens
MPNPSSTSSPYPLPEEIRNLLADVETSVARYTETRTTLSTKAKEPERIPYLPKTTHDVKSNLLFSELSKDQKVTARTTGATNTDDPFAWASRHYFISLRHDTDSQTDEAPLCCTPKFPPIAAQDLPFVLTGWLPLHTRITRLPAFWRSDHSAQHRMRVTSSAYLPAYSLPPFIAHLTTPTTPHTTSVELRPHHLPTPLPPIAIPLPTHPPDHP

SEQ ID NO: 874158 - protein, 241 aa, Homo sapiens
FFFLEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLGVLQVVSSQDHNSRGLFPRRFLKAKPLDTVL

SEQ ID NO: 874159 - protein, 213 aa, Homo sapiens
FFFLEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKCLKFLGSRHPTLVLPLVPELLSTHPFFDTAEPDMDDPAYIAVLVLIFNAAKTCPTMPALFSDHTFRHYAYLRRQVMEGDLQNGNFMYSGVGGIKQVGGYTFT

SEQ ID NO: 874160 - protein, 230 aa, Homo sapiens
MTTTGETRTRKNGSAKQERGRQTSPPEKNKKYGSKTPRRKNKKQTDRQKIPEKTKNTKRDQTKERKEDATKKRNKKKKKTEKTRRRRQTKKNKRPQRPTARGDRPAPPATQKTTRTKKRKQKKDSSGGNAEDKERQCRYYRRGKRRKEPSSDCTDNKRTPERAETGAREEDSTEEENRAAEEKSGDRERRETADKKTRTEQHKKKPGKEPTKRNDKRRREQDTAQKDEER

SEQ ID NO: 874161 - protein, 202 aa, Homo sapiens
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEANVTQDLKLPGFVEESCEHTDQFQLSSQMHESIREYSVQRQFSTKEDTNNK

SEQ ID NO: 874162 - protein, 202 aa, Homo sapiens
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEANVTQDLKLPGFVEESCEHTDQFQLSSQMHESIREYLVQRQFSTKEDTNNK

SEQ ID NO: 874163 - protein, 738 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 874164 - protein, 145 aa, Homo sapiens
PVHLYLLPSSFQEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQVTHQPPAAPASLKPNSESRAVTWWLA

SEQ ID NO: 874165 - protein, 656 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLFQ

SEQ ID NO: 874166 - protein, 106 aa, Homo sapiens
MEKSRMNLPKGPDTLCFDKDEFMKVRAASAPRSRAMRVPLPCALCGVSSVGCSCLRTLSVRSSAETSLHFAMSLLASGLAGAAWRKHFCKIVRVTWKGLKVLGKWF

SEQ ID NO: 874167 - protein, 248 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDGDIIRDLVADLRQRLDQRTGDGGRP

SEQ ID NO: 874168 - protein, 116 aa, Homo sapiens
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLVSFPNNIKQFTLKHDM

SEQ ID NO: 874169 - protein, 738 aa, Homo sapiens; identical to SEQ ID NO: 874163

SEQ ID NO: 874170 - protein, 104 aa, Homo sapiens
PCTSCQCCPARQCHPSSQLQALVFLLHTELRGHFPVLPEIFHQGAPSHHQGKQGLESLLMCKTLIQVGRKSLSGHKTRQHLQIFLQKGPFSQIQPRQMFKLEHR

SEQ ID NO: 874171 - protein, 124 aa, Homo sapiens
RDHESSQGRAQVVRRGGQGAWLRHPGPTWLGGHHWVGVSYYGRGRLGTLTERLLPTPTSQAWENCPHCAAGVSAPTGIRGRPGLKGTPGPTSTFCKARQGSGMLPGGCGWATAWGLSHKLRFGK

SEQ ID NO: 874172 - protein, 114 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTG

SEQ ID NO: 874173 - protein, 140 aa, Homo sapiens
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLW

SEQ ID NO: 874174 - protein, 921 aa, Homo sapiens
MESHPVSSQVQVIVMPQPPEVAEITGTCYHAQLIFVVLVETVIWFGCVPTQSQLELYLQEFPCVVGGTQGRQLNHRAGLFCAILVIVSKSHADLIGLLGVSAFASSSFFLLPLPCKKCLSPPAMILRLPQPCGTVSPIKPLFVPSFGYIFFSSVKMECTHTSALWAHTPALTHSSGPMGTRAHTRQSCGCTHLHSHIHQDPWAHVHTRQHRERTHLHSRTHLHSRTQDRRTYVHTHISTVGAHTCTQRTRQDPRADVHTCTSTRGHVHAHISTHGHTWMHTSVPWAHTHAPTPDGFGLLGACFALRVSKSGGRHLGWGHSMVLRSPVSPGPTCSQPWVPKCCSHWSLCPTHHGQGCLNRAESRVMQGWGVEALPRGSSQLWLGWALPSLSCCETQEPWGRTAVCIRAVVKLQIPKCDLETTLAGEIYPGPLGLSLPSPSTVRDRLRGVPPHLCVASAQQAFLPIAKGRARQIHCVVRASPDPPTPVSSHGEKGGVSLGPFFFYEVTDATQVGAQLTHLISGVAPSAGGCPRLDAVACRPPFLQSLGRQHPCAHVHTGREHCPVSQVVVGGVGAKVWLGPECLRTPPSNFPWCWDAAASWTLALKCHLHLPPQTVSSRQGQAVAVTLAAARGLGGCWVVAWTLPSCLLVSRRGLAGLGPPPPHWAPDSQGAVSSLGMALISERDCLWPFFCIPYENSSLLDALRRQAEGWKGRGRAQQRPPSDDGGRPFQPLSGHRFIPSPISFLALLSKSCVCGGGLASLPASRLFPPIPLWFSQASSGLARNVGELGGGGHRKCLPSSDNSSSCRGRGEGRAEWVRRGRAEGGSRLGGRVFSCPPRHWAWPSPTDRTVLSSLFYFLLETGSHSVAQAGVQSCDWPQSDSPTSAFQSTGITAVSQCAQPLPKFTPVWASSEGNWPVMRWSL

SEQ ID NO: 874175 - protein, 140 aa, Homo sapiens
LCSCALPAFPWQAFYWLNKDTNFSSVFANTWFRQVLGPSQAWGCRLTVLLSAFQPGPHMLGLQVTTTHDGCAAWGAVPRGRRGWCGAASRSLHQPPEGPCPGRGRVCSAVWVVSPPQGPPGWCPLLPHGRKSQRHLATSL

SEQ ID NO: 874176 - protein, 359 aa, Homo sapiens
GSRAMSRACKKCLSPPAMILRLPQPCGTVSPIKPLFVPSFGYIFFSSVKMECTHTSALWAHTPALTHSSGPMGTRAHTRQSCGCTHLHSHIHQDPWAHVHTRQHRERTHLHSRTHLHSRTQDRRTYVHTHISTVGAHTCTQRTRQDPRADVHTCTSTRGHVHAHISTHGHYMDAHISTMGTHTCTHSRWLRLAGCLLRPRVSKSGGRHLGWGHSMVLRSPVSPGPTCSQPWVPKCCSHWSLCPTHHGQGCLNRAESRVMQGWGVEALPRGSSQLWLGWALPSLSCCETQEPWGRTAVCIRAVVKLQIPKCDLETTLAGEIYPGPLGLSLPSPSTVRDRLRGVPPHLCVASAQQACPAHC

SEQ ID NO: 874177 - protein, 89 aa, Homo sapiens
RSGWGRGRGRGLQMPPPPPFLVRGPHGVGEQEESIRIMKPQPATHCGGTEERGPVPSPPDGSEERSPARPGGGGGGGGGGDGGNPKAAR

SEQ ID NO: 874178 - protein, 81 aa, Homo sapiens
MKDFPGLVQESRASADAQEARQRTSMIRDTPAVSEVPGSQPPSHPRWCGPSAGHDGTTITGYQAGNLAADQNGPKIGEGGI

SEQ ID NO: 874179 - protein, 522 aa, Homo sapiens
VRAGPRSALPSGSWRPSLPCSAVAARTGAREPGWGQGLEPRDQRLRCPGEAMELSSKKKLHALSLAEKIQVLELLDESKMSQSEVARRFQVSQPQISRICKNKEKLLADWCSGTANRERKRKRESKYSGIDEALLCWYHIARAKAWDVTGPMLLHKAKELADIMGQDFVPSIGWLVRWKRRNNVGFGARHVLAPSFPPEPPPPGLTSQAQLPLSLKDFSPEDVFGCAELPLLYRAVPGSFGACDQVQVLLCANSRGTEKRRVLLGGLQAAPRCFFGIRSEALPASYHPDLGIPWLEWLAQFDRDMGQQGRQVALLLAARVVEELAGLPGLYHVKLLPLAASSTTPPLPSSVVRAFKAHYRHRLLGKLAAIQSERDGTSLAEAGAGITVLDALHVASAAWAKVPPQLIFSSFIQEGLAPGKTPPSSHKTSEMPPVPGGLSLEEFSRFVDLEGEEPRSGVCKEEIGTEDEKGDREGAFEPLPTKADALRALGTLRRWFECNSTSPELFEKFYDCEEEVERLCCL

SEQ ID NO: 874180 - protein, 522 aa, Homo sapiens; identical to SEQ ID NO: 874179

SEQ ID NO: 874181 - protein, 74 aa, Homo sapiens
GVVGHHAPTDPVGQGQVRRLPRQGHLDAGGAQQDEVGQLPFPDPLQALVDLGGVHLSLDGVEDGDVGVVGLAVS

SEQ ID NO: 874182 - protein, 404 aa, Homo sapiens
SFKPLKMENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 874183 - protein, 150 aa, Homo sapiens
MSGSMATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 874184 - protein, 150 aa, Homo sapiens; identical to SEQ ID NO: 874183

SEQ ID NO: 874185 - protein, 150 aa, Homo sapiens; identical to SEQ ID NO: 874183

SEQ ID NO: 874186 - protein, 150 aa, Homo sapiens; identical to SEQ ID NO: 874183

SEQ ID NO: 874187 - protein, 150 aa, Homo sapiens; identical to SEQ ID NO: 874183

SEQ ID NO: 874188 - protein, 114 aa, Homo sapiens
VWPIVLAPRGKNATGRIRGEGTSAAPKQVSSFRPKVDASESFEDVGHSSDAREMLKQYYIGDIHPSDLKPESGSKDPSKNDTCKSCWAYWILPIIGAVLLGFLYRYYTSESKSS

SEQ ID NO: 874189 - protein, 127 aa, Homo sapiens [sequence omitted]

SEQ ID NO: 874190 - protein, 329 aa, Homo sapiens
MGGDILGPHVPEVGTFPLTHELKVYRTATEIAGSHRHILEGQPHRSPSQQQLLHKIFHHLRAVVGGGCQAQELFTPGDSWVVDGLHIDAMLGEQEITELAVECCIAHPDGDDVAGAGDDRKAPVHEELAHVLDIALVGSPQGLALLSLEQPHRFQSSREHHGGQRSGKDEACSIGAHHVHQVTGAGNVAAHTAKGLAKSSRDDVNLMHNSITLPNPSAPGPIQSYSMDLIHEGQGPNWWDTSHNSSRGQMAPSMEWTVSKATILGILGLDFSRSFFEVVRVIVPEDKLGCSTWLRKPRKAERGLSRKVVAESQLAVERQYVRFNGDCGS

SEQ ID NO: 874191 - protein, 109 aa, Homo sapiens
MATAEASGSDGKGQEVETSVTYYRLEEVAKRNSLKELWLVIHGRVYDVTRFLNEVGPGRWEASEAAGARGEKAVWSVCGKEGRLGWGRYGVRKGSRPSEGNWGGIGGGL

SEQ ID NO: 874192 - protein, 150 aa, Homo sapiens; identical to SEQ ID NO: 874183

SEQ ID NO: 874193 - protein, 150 aa, Homo sapiens; identical to SEQ ID NO: 874183

SEQ ID NO: 874194 - protein, 150 aa, Homo sapiens; identical to SEQ ID NO: 874183

SEQ ID NO: 874195 - protein, 150 aa, Homo sapiens; identical to SEQ ID NO: 874183

SEQ ID NO: 874196 - protein, 132 aa, Homo sapiens
MSGSMATAEASGSDGKGQEVETSVTYYRLEEVAKRNSLKELWLVIHGRVYDVTRFLNEHPGGEEVLLEQAGVDASESFEDVGHSSDAREMLKQYYIGDIHPWCRTKNYMALSCLGGGKGGMNWGDRTLVNSE

SEQ ID NO: 874197 - protein, 121 aa, Homo sapiens
MATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKRLVSP

SEQ ID NO: 874198 - protein, 150 aa, Homo sapiens
NSPTHTSLRHHHDRLLLRLHLVLPELRGRLLPALLLPRPLLLPPRDLPDHRVPPRDLRAPLHAPHLRALPPPGVLRPLLPAGRLLPPHHLLPLVVHGCGVQALLLGHHLLPACVCAVPLLPAPLRPADPLQHHLQDLLLLRPQCPHRAIH

SEQ ID NO: 874199 - protein, 102 aa, Homo sapiens
MMKLKSNQTRTYDGDGYKKRAACLCFRSESEEEVLLVSSSRHPDRWIVPGGGMEPEEEPSVAAVREVCEEPTQCEDDEEKTFTGLHFHLMNSKYIFSSLWFS

SEQ ID NO: 874200 - protein, 171 aa, Homo sapiens [sequence omitted]

SEQ ID NO: 874201 - protein, 120 aa, Homo sapiens
MEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSSMSGIR

SEQ ID NO: 874202 - protein, 151 aa, Homo sapiens
MKLKSNQTRTYDGDGYKKRAACLCFRSESEEENQERKHRTYVYVLIVTEVLEDWEDSVNIGTPNFLPKEPFSLISDGCYVYIFGTINCGGDKGRKREWFKIEDAIKVLQYHKPVQASYFETLRQGYSANNGTPVVATTYSVSAQSSMSGIR

SEQ ID NO: 874203 - protein, 130 aa, Homo sapiens
MKLKSNQTRTYDGDGYKKRAACLCFRSESEEEVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLGL

SEQ ID NO: 874204 - protein, 171 aa, Homo sapiens [sequence omitted]

SEQ ID NO: 874205 - protein, 171 aa, Homo sapiens [sequence omitted]

SEQ ID NO: 874206 - protein, 248 aa, Homo sapiens
HVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSSMSGIR

SEQ ID NO: 874207 - protein, 173 aa, Homo sapiens
GPRGGWRDLGSSSAAETRRDLGQVPASPSADLRGWTARSPLRPLGVLRRCSYLPRLPPRTPPVLRLRCRRSGRLESRVPLLSDAGFHRANWEGAIRERGLRCERAAVPQAECSLTPLTHRAQDGGAVVVGGGGGRGGGGPGGSGDGSRDGGSGGAGPGPGGMRRPRRASGGAV

SEQ ID NO: 874208 - protein, 66 aa, Homo sapiens
PCYAGSIYGSGAGQTGHSDNQQAAAFHYHLTGARHPGRPGLLQILSQPLNFYREGFVDQNFDLVNA

SEQ ID NO: 874209 - protein, 232 aa, Homo sapiens
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 874210 - protein, 232 aa, Homo sapiens; identical to SEQ ID NO: 874209

SEQ ID NO: 874211 - protein, 232 aa, Homo sapiens; identical to SEQ ID NO: 874209

SEQ ID NO: 874212 - protein, 277 aa, Homo sapiens
MAWSGWVNGRGWGVAYALGWAADRRARKGPRAPNLGGRCSSAACAMASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 874213 - protein, 191 aa, Homo sapiens
MKTYKGCPSGCWGRRGPLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 874214 - protein, 229 aa, Homo sapiens
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRSDNQQAAAFHYHLTGARHPGRPGLLQILSQPLNFYREGFVDQNFDLVNA

SEQ ID NO: 874215 - protein, 232 aa, Homo sapiens; identical to SEQ ID NO: 874209

SEQ ID NO: 874216 - protein, 232 aa, Homo sapiens; identical to SEQ ID NO: 874209

SEQ ID NO: 874217 - protein, 232 aa, Homo sapiens; identical to SEQ ID NO: 874209

SEQ ID NO: 874218 - protein, 232 aa, Homo sapiens; identical to SEQ ID NO: 874209

SEQ ID NO: 874219 - protein, 427 aa, Homo sapiens
MPGSYFGFLVELSLLCPGWSRTTGFKQSSHLGLPKYWDYRREPLARPGSTSESLGSRWAFQEKCSTSRRQAEPLARLSFQGRKLTVKTRNEEFGQGGKAKRDDSEDDVYDANIHQIGPKPAVAARAEPGTRSNARPRDETLSSEPNYIPRRALQRPPLAGRRGPGGRRPRCQSRRSPRPLSLRPFPNPDPALLGFRDSSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 874220 - protein, 66 aa, Homo sapiens; identical to SEQ ID NO: 874208

SEQ ID NO: 874221 - protein, 70 aa, Homo sapiens
PSTVFTPRVIGTAVARYNFAARDMRELSLREGDVVRIYSRIGGDQGWWKGETNGRIGWFPSTYVEEEGIQ

SEQ ID NO: 874222 - protein, 115 aa, Homo sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 874223 - protein, 164 aa, Homo sapiens
FLLVSNYLKLKKSVHRPMGVCMCCFEPIVEIQRIGSDIICNNKRASLVKMIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 874224 - protein, 30 aa, Homo sapiens
MLSPFLPLMFVNPSWYRWINNRLVATWLTL

SEQ ID NO: 874225 - protein, 323 aa, Homo sapiens
RSAEPANQLPLPLPCPLRVAASRVGGQELRGADPGPPACEAHSQVERASSTLRSPAFMREIPRSRLRPPPCFKHQRGPGVLAGDRPNLRSCFCTRYIDRSDGLRARKSWRDEASVQLLPQTTARRALSPGSVKSPAPGGDNMRAMDGAGTPGSPSNPQGSGGAGGVGDTLRPLQARSIPSARSPVRRRVLWYMGPAARPRRFVPGPPGDATTLELYTKVCLPRKRWRLPLGRLARSPRLQAPRVRAGSSHSCKEAAKYVFQTFHGSKLSASIKRSGVRGKSILGISMQMNGPGFQLRSGFPPLRAELAPSHARPEASGRCPGG

SEQ ID NO: 874226 - protein, 323 aa, Homo sapiens; identical to SEQ ID NO: 874225

SEQ ID NO: 874227 - protein, 143 aa, Homo sapiens
LSPSLLTPSFTGSMSPSVAQSLSVTLPATPSFSFLPPASLCISPSHPCLLSSLSFSSSPCHASLITPPHSAFPPTHGLLSLSLSLSPPPSFSLSLFLHLLPTPFPLYFYWLLCPLLPSSLPHPGKLLPPILAPAPPGCVLEMG

SEQ ID NO: 874228 - protein, 106 aa, Homo sapiens
GVLGSPGCAGSFLGVLGSPGYAEFSWVCWVLPGGLGSLRCAGSFLVCWVLLCVLGPPWWAVFPQVCWVLPGMLGPPACAASFLCVLGSPRFAGSSQVCWVPPPGNP

SEQ ID NO: 874229 - protein, 140 aa, Homo sapiens
MEDYALTFGINPFIALMIQPIVTMTVVDNQGLGLPVDIQHKAKPSPKASQMLPPDLGPPSFQNLLSPSEKLEPWDPGMRKLTVQTCGLTFIHPAGHGLCHPTAQASAETLSSTALNRPSVREGACNEKSTENKKPQDSVL

SEQ ID NO: 874230 - protein, 425 aa, Homo sapiens
MELYFGEYQHVQQEYGVHLRLASDDTQKSRSSQNSKAGSYGVSIRVQGIDGHPYIVLNNTERCLAGTSFSENGPPFPPPVINNLPLHSSNGSVPKENSEELQLPENPYAQPSPIRNLKQPLLHEGKNGVLDRKDGSVKPSHLLNFQRHPELLQPYDPEKNELNLQNHQPSESNWLKTLTEEGINNKKPWTCFPKPSNSQPTSPSLEDPAKSGVTAIRLCSSVVIEDPKKQTSVCVNVQSCTKERVGEEALFTSGRPLTAHSPHAHPETKKTRPDVLPFRRQDSAGPVLDGARSRRSSSSSTTPTSANSLYRFLLDDQECAIHADNVNRHENRRYIPFLPGTGRDIDTGSIPGVDQLIEKFDQKPGLQRRGRSGKRNRINTDDRKRSRSVDSAFPFGLQGNSEYLIEFSRNLGKSSEHLLRPSQVC

SEQ ID NO: 874231 - protein, 239 aa, Homo sapiens
AQTEQTAAATHPIDKVQLAKVEDGKRMELSQLLNEIRANYEKILTRNQIETVLSTRIQLEEDISKKMDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKGEH

SEQ ID NO: 874232 - protein, 173 aa, Homo sapiens
MDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKGEH

SEQ ID NO: 874233 - protein, 170 aa, Homo sapiens
MIPKSALFYIYYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEATSAL

SEQ ID NO: 874234 - protein, 47 aa, Homo sapiens
VISTHCEASGHRVLPSSLLQGGEAPSPVLTMSIQSLFTVSLCPVEAT

SEQ ID NO: 874235 - protein, 297 aa, Homo sapiens
ERPGGGGARRRPQHLPALLPSERPDCATLQAMENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPA

SEQ ID NO: 874236 - protein, 47 aa, Homo sapiens
RNVTQHPSRSNTDTLCTRMYSKALSIPRNTNPGGSEAHKHQHSCQPS

SEQ ID NO: 874237 - protein, 566 aa, Homo sapiens
KTQAPYALKEAWPLRRSVVGLVAGANREETAGVAVARLGITPGDWPARFVPAGSRAGGLFGNSEPQRNMALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 874238 - protein, 566 aa, Homo sapiens; identical to SEQ ID NO: 874237

SEQ ID NO: 874239 - protein, 408 aa, Homo sapiens
MQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 874240 - protein, 346 aa, Homo sapiens
MELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 874241 - protein, 330 aa, Homo sapiens
KTQAPYALKEAWPLRRSVVGLVAGANREETAGVAVARLGITPGDWPARFVPAGSRAGGLFGNSEPQRNMALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREAEITKEEQRKLIAEQLLYEHWKKNNPKLREMELDLHQKHVVNSWEMQKEGKKQQEATAEQENKRY

SEQ ID NO: 874242 - protein, 72 aa, Homo sapiens
LKKEQENLLKQRWELERLEEERKQMEAFRQKAELGCVSEGPPTLPRRVGLLLFQTCIRVAETIKETAWSAVI

SEQ ID NO: 874243 - protein, 566 aa, Homo sapiens; identical to SEQ ID NO: 874237

SEQ ID NO: 874244 - protein, 498 aa, Homo sapiens
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 874245 - protein, 320 aa, Homo sapiens
KTQAPYALKEAWPLRRSVVGLVAGANREETAGVAVARLGITPGDWPARFVPAGSRAGGLFGNSEPQRNMALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEADQTKEGAGESVVHFLATL

SEQ ID NO: 874246 - protein, 227 aa, Homo sapiens
KTQAPYALKEAWPLRRSVVGLVAGANREETAGVAVARLGITPGDWPARFVPAGSRAGGLFGNSEPQRNMALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREVKIRDLH

SEQ ID NO: 874247 - protein, 107 aa, Homo sapiens
MVTQGSQGEGRPFLSAESAGPAQEQPNGYRCSHDSECQSSCCVRNNSPQELCTPQSVFLQCVPWRKPNGDFCSSHQECHSQCCIQLREYSPFRCIPRTGILAQCLPL

SEQ ID NO: 874248 - protein, 103 aa, Homo sapiens
RPLASAKKLPTPSWRASPQSPPRRDRAYGLANAAATPACLSCSRRSASPQPSHAEESGWCRGLNFSLGSGPKGLPRPLEPAYFLYSLAVWLLPPSWVTSGCRH

SEQ ID NO: 874249 - protein, 41 aa, Homo sapiens
KNEAVALHSPSWPCWGANSRDANAVPRLHRRPRQVWVRQGP

SEQ ID NO: 874250 - protein, 91 aa, Homo sapiens
IASAWPGERKGLVWESPLHCQDGATGRYLGGRKPVSPWGWLGAGPRVMTTVLFLPPGAPFDPVRLLGNAVSSVTCSCLREPLWLRGPGVPE

SEQ ID NO: 874251 - protein, 36 aa, Homo sapiens
SERSWACLFVPLLGCYSRKQTQRWPHHIIGLLDFIS

SEQ ID NO: 874252 - protein, 106 aa, Homo sapiens
TLLVSMEANTNSIFIKTISHLKIHKNKYTEAYIFPFASGFSTAYMALVTTVDLKCWGSSENCPTEKVGNLGSLFRAFPVGVDSGTPHHAHSGEAKTCWKGTIIVCC

SEQ ID NO: 874253 - protein, 81 aa, Homo sapiens
LSARQPPHLVELKKILYQKKMATAQLQRTPMSALVFPNKISTEHQSLVLVKRLLAVSVSCITYLRGIFPECAYGTRYLDGC

SEQ ID NO: 874254 - protein, 407 aa, Homo sapiens
ALRESACASGTARAASCSSSGLRRPPLRRNVELKKILYQKKMATAQLQRTPMSALVFPNKISTEHQSLVLVKRLLAVSVSCITYLRGIFPECAYGTRYLDDLCVKILREDKNCPGSTQLVKWMLGCYDALQKKYLMVVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMVLHHFDSSSQESVPKRRKFSEPKEHI

SEQ ID NO: 874255 - protein, 295 aa, Homo sapiens
MVITGYLLSKTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 874256 - protein, 365 aa, Homo sapiens
ALRESACASGTARAASCSSSGLRRPPLRRNVELKKILYQKKMATAQLQRTPMSALVFPNKISTEHQSLVLVKRLLAVSVSCITYLRGIFPECAYGTRYLDDLCVKILREDKNCPGSTQLVKWMLGCYDALQKKYLMVVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLDNKIDTRN

SEQ ID NO: 874257 - protein, 431 aa, Homo sapiens
ALRESACASGTARAASCSSSGLRRPPLRRNVELKKILYQKKMATAQLQRTPMSALVFPNKISTEHQSLVLVKRLLAVSVSCITYLRGIFPECAYGTRYLDDLCVKILREDKNCPGSTQLVKWMLGCYDALQKKYLMVVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 874258 - protein, 431 aa, Homo sapiens; identical to SEQ ID NO: 874257

SEQ ID NO: 874259 - protein, 319 aa, Homo sapiens
MRLWNKISRWMLGCYDALQKKYLMVVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 874260 - protein, 319 aa, Homo sapiens; identical to SEQ ID NO: 874259

SEQ ID NO: 874261 - protein, 66 aa, Homo sapiens
GEPESSGRAGLLPAQAGGLGLRSRAKNRPARRGSALQGCCPVPGQGHIRIGKRQAHGSTGSLTGAR

SEQ ID NO: 874262 - protein, 153 aa, Homo sapiens
MEDPVFIDATWKKVGWLQHFLRSIMILSSDTWFPPPREFKASKFRVRMYLKYFFCMGLSSTRTMSSAGLASTLPTERVERVLQGCLTPLAAMGPWLLQSSVSSQVECCPAPGPAGNDSAPDVHPQELGLLASLTPPSVHICLPGRMVLPLSLG

SEQ ID NO: 874263 - protein, 102 aa, Homo sapiens
FKEPDRRYSRAGTYLYPFSSSIWFPWRQLPHLEPWPRLAPGASHSWGEAKDLAVTSQAQDQGPFLGWALGLGLEETLMVQASLGGEDSKHRVKCWWGPPFAR

SEQ ID NO: 874264 - protein, 54 aa, Homo sapiens
QPPWPKLPLSSVDDMLKVSSRVSSGGLFLQDDPVGTRRGGAGLSPSWSGCHTSC

SEQ ID NO: 874265 - protein, 386 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874266 - protein, 386 aa, Homo sapiens; identical to SEQ ID NO: 874265

SEQ ID NO: 874267 - protein, 386 aa, Homo sapiens; identical to SEQ ID NO: 874265

SEQ ID NO: 874268 - protein, 386 aa, Homo sapiens; identical to SEQ ID NO: 874265

SEQ ID NO: 874269 - protein, 386 aa, Homo sapiens; identical to SEQ ID NO: 874265

SEQ ID NO: 874270 - protein, 386 aa, Homo sapiens; identical to SEQ ID NO: 874265

SEQ ID NO: 874271 - protein, 254 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTGTTASPAPRTSSLSWASPSLAAQIAPLPTKTKP

SEQ ID NO: 874272 - protein, 386 aa, Homo sapiens; identical to SEQ ID NO: 874265

SEQ ID NO: 874273 - protein, 368 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTSGLDGVAQGW

SEQ ID NO: 874274 - protein, 386 aa, Homo sapiens; identical to SEQ ID NO: 874265

SEQ ID NO: 874275 - protein, 386 aa, Homo sapiens; identical to SEQ ID NO: 874265

SEQ ID NO: 874276 - protein, 386 aa, Homo sapiens; identical to SEQ ID NO: 874265

SEQ ID NO: 874277 - protein, 364 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTRPRGCSGIPPQPLVSLPLSLV

SEQ ID NO: 874278 - protein, 195 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLGGPGPVARSRAAMSP

SEQ ID NO: 874279 - protein, 343 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDEDRPLGRRILLTDRNPQHHLASTPPEENPILYQHLF

SEQ ID NO: 874280 - protein, 386 aa, Homo sapiens; identical to SEQ ID NO: 874265

SEQ ID NO: 874281 - protein, 494 aa, Homo sapiens
PRVATRRPRVRGRVGFWVKGPVCRGILWLEARRLHTAVAATAARIWASRHGHDPSEALLGVAAGCRNPSHQRECAGRGRPGLLWPHGHPDCQPGRPRPCGKEPGSNVTMSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874282 - protein, 475 aa, Homo sapiens
TNRAGTPRLARQVIIMSSVYTRHLCRLHCPDWGQLRPWFPEGNLKLAKAPHQRECAGRGRPGLLWPHGHPDCQPGRPRPCGKEPGSNVTMSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874283 - protein, 433 aa, Homo sapiens
ACVCVQLRECMCDCVVYMCMHEYCTHTHAHSHTVCTQVAVLDSWAQGSPAVLWGRHLLSFFLPRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874284 - protein, 358 aa, Homo sapiens
LRSPGVVLVLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874285 - protein, 195 aa, Homo sapiens; identical to SEQ ID NO: 874278

SEQ ID NO: 874286 - protein, 259 aa, Homo sapiens
IRGSCGGRKSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874287 - protein, 195 aa, Homo sapiens; identical to SEQ ID NO: 874278

SEQ ID NO: 874288 - protein, 213 aa, Homo sapiens
VVSVRVVLRGKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874289 - protein, 170 aa, Homo sapiens
CRGPDCHRKGTGVLWSLEGLIGVVSVVRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874290 - protein, 195 aa, Homo sapiens; identical to SEQ ID NO: 874278

SEQ ID NO: 874291 - protein, 92 aa, Homo sapiens
MTPPRLFWVWLLVAGTQGVNDGDMRLADGGATNQGRVEIFYRGQWGTVCDNLWDLTIFFLSLFYTHSLFISQLSFPIILYYFHTLTYSLSYF

SEQ ID NO: 874292 - protein, 72 aa, Homo sapiens
MSPYSPERSASRNYWKASTRVHQEFSHHLTSFQVVSTRTPSRLLWDPPTAPGQSALVTRVVTQAHSVGSSPV

SEQ ID NO: 874293 - protein, 386 aa, Homo sapiens; identical to SEQ ID NO: 874265

SEQ ID NO: 874294 - protein, 367 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874295 - protein, 386 aa, Homo sapiens; identical to SEQ ID NO: 874265

SEQ ID NO: 874296 - protein, 385 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYAISRAGRLRFPVPWTPTARRAPPPSPCPAGHFNGVPHGHPPLLPDQLLRCGLDGVAQGW

SEQ ID NO: 874297 - protein, 339 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDEAGHFNGVPHGHPPLLPDQLLRCGLDGVAQGW

SEQ ID NO: 874298 - protein, 386 aa, Homo sapiens; identical to SEQ ID NO: 874265

SEQ ID NO: 874299 - protein, 195 aa, Homo sapiens; identical to SEQ ID NO: 874278

SEQ ID NO: 874300 - protein, 386 aa, Homo sapiens; identical to SEQ ID NO: 874265

SEQ ID NO: 874301 - protein, 386 aa, Homo sapiens; identical to SEQ ID NO: 874265

SEQ ID NO: 874302 - protein, 320 aa, Homo sapiens
MPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874303 - protein, 276 aa, Homo sapiens
MSVDAELCAHGSRDLLRYFYSRRDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPFNDKRTSFNDN

SEQ ID NO: 874304 - protein, 254 aa, Homo sapiens; identical to SEQ ID NO: 874271

SEQ ID NO: 874305 - protein, 368 aa, Homo sapiens
MIKKKDLTSPWSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874306 - protein, 370 aa, Homo sapiens
MTPPRLFWVWLLVAGTQGVNDGDMRLADGGATNQGRVEIFYRGQWGTVCDNLWDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874307 - protein, 260 aa, Homo sapiens
TLSLWGTLSLSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874308 - protein, 252 aa, Homo sapiens
VIKRSLAEWHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874309 - protein, 237 aa, Homo sapiens
KARYEAGVVSAEANVFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPLPGRALQRRSARSSAPST

SEQ ID NO: 874310 - protein, 133 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGTSTPEGI

SEQ ID NO: 874311 - protein, 113 aa, Homo sapiens
HASPRVAHASADAWASGSKDQSAEGSCGWKRGGSTRPLQLPQPGSGHPGTAMTPPRLFWVWLLVAGTQGELSPWEIPKAEVWKAGAPWGCSELQGDILPGARGPAVSQIFSPA

SEQ ID NO: 874312 - protein, 456 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERGGFRGGRGGAHRGGFPPR

SEQ ID NO: 874313 - protein, 314 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKAGSQLDQRLQIATTMQKHMHPISVLLIPT

SEQ ID NO: 874314 - protein, 428 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPAWLTVALLFQLNGPLFCFVAAATLNLDHVRTCTFMGSCSVQMFYHKDIFLVILSILISFFPVFTFLCTLYISM

SEQ ID NO: 874315 - protein, 456 aa, Homo sapiens; identical to SEQ ID NO: 874312

SEQ ID NO: 874316 - protein, 439 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERG

SEQ ID NO: 874317 - protein, 256 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVVRWCFYKVDF

SEQ ID NO: 874318 - protein, 565 aa, Homo sapiens
RSGRARRCHVEEPPLPLPPPPPPLCCRLLRLRRLPERGEWGGGGSAAAAMEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 874319 - protein, 364 aa, Homo sapiens
MPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 874320 - protein, 364 aa, Homo sapiens; identical to SEQ ID NO: 874319

SEQ ID NO: 874321 - protein, 431 aa, Homo sapiens
MPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAGVTI

SEQ ID NO: 874322 - protein, 70 aa, Homo sapiens
MDSPLQQQQQQQQQQQQQQQQQHVTSWPGKQVETLRLWEEAVKARKKEAANQCAQTSTVCYSLVDGGTAA

SEQ ID NO: 874323 - protein, 569 aa, Homo sapiens
RSGRARRCHVEEPPLPLPPPPPPLCCRLLRLRRLPERGEWGGGGSAAAAMEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 874324 - protein, 364 aa, Homo sapiens; identical to SEQ ID NO: 874319

SEQ ID NO: 874325 - protein, 82 aa, Homo sapiens
RTHTGERPFSCDWLDCDKKFTRSDELARHYRTHTGEKRFSCPLCPKQFSRSDHLTKHARRHSPARWKAPPPAPVPARRPASP

SEQ ID NO: 874326 - protein, 173 aa, Homo sapiens
QNFHPDSEAAINRQINLELYASYVYLSMAYYFSRDDVALNNFSRYFLHQSREETEHAEKLMRLQNQRGGRIRLQDIKKPEQDDWESGLHAMECALLLEKNVNQSLLELHALASDKGDPHLCDFLETYYLNEQVKSIKELGDHVHNLVKMGAPDAGLAEYLFDTHTLGNENKQN

SEQ ID NO: 874327 - protein, 109 aa, Homo sapiens
GRGGLGCRSWRCAGSSRPYSEVFSVALLERGSSCILRIFCISAPFSSRCHRMPQIGPVPSVNQTSETASLQGQSPSTDELEDSECTPGSRPYRHTLGQTSPYTTQERTP

SEQ ID NO: 874328 - protein, 143 aa, Homo sapiens
MSSNLLPTLNSGGKVKDGSTKEDRPYKIFFRDLFLVKENEMAAKETEKFMNRNMKVYQKTTFSSRMKSHSYLSQLAFYPKRSGRSFEKFGPGPAPIPRLIEGSDTKRTVHEFINDQRDRFLLEYALSTKRNTIKKFEKDIAMR

SEQ ID NO: 874329 - protein, 152 aa, Homo sapiens
LCHQTVLPEAPLPESQPASPAVKSEGVRPPPSASQLPRSLVYDPDIANLPGPPFLFFIMDVSDGTYAVSLPKDQSEHINPFNSCFPSPSMLAHLTGAKAQVLPLAQAALRDRFPFASAPSRSPVSCHFPLSPHLLLSTSLILFQPPGLPAGS

SEQ ID NO: 874330 - protein, 73 aa, Homo sapiens
MSTNDAFPMALLPLPHSDPDSLPCILPILHSMFPQLHLLPCNQRMAHDEHQNGGNSSPFPSRCCVCPAQTRAP

SEQ ID NO: 874331 - protein, 101 aa, Homo sapiens
MLTLPMSCVGPALPGGNQRWSAFWRDRSRAHTMPLVVWTPLVHTGTDSVFSSTAATKGPPTERLQNLKLILSQQWGLQSKIRVPAGHAIWKGPRGESVPCL

SEQ ID NO: 874332 - protein, 104 aa, Homo sapiens
QAGRNGRCALPGDSDSTFPHLCPGLACLQALIDVHIVIVPHLVPGETLAAASPKGQPEDTAKCQFQPWRYRGVRCVGPWVPERIHLCLSLFCAAMTEYMRSDNG

SEQ ID NO: 874333 - protein, 102 aa, Homo sapiens
GPIPAPGQTQWLQAPDQLPTALIMRLALTDPGFRLILVDSSDGPASMDPSSRTTLVDPGFRLAPKAPGPRLDFADLTPRPAPAHSASRPTQVDPGSSQTPKL

SEQ ID NO: 874334 - protein, 80 aa, Homo sapiens
MDVAPPSPFLSGTHTAVRLIHGPPPSSLARCRGHPCCLPYDASSVVSDALFSIGRCACLLGAFAFFCVEILFSLSFALHL

SEQ ID NO: 874335 - protein, 82 aa, Homo sapiens
QRVHTGEKPYKCRECGKAFRWSSNLYRHQRIHSLQKQYDCHESEKTPNVEPKILTGEKRFWCQECGKTFTRKRTLLDHKGIH

SEQ ID NO: 874336 - protein, 87 aa, Homo sapiens
MSGRTAPFTCGETQRRGRVLSPVLLFTGSPVSHPPEMEANPAGSGAGGGGSSGIGGEDGVHFQSYPFDFLEFLNHQRFEPMELYGEH

SEQ ID NO: 874337 - protein, 39 aa, Homo sapiens
SYSELHHTLLLTLVILLCTRMYSFCLTVCPLGPVDRSLS

SEQ ID NO: 874338 - protein, 118 aa, Homo sapiens
EIPFDGVLVCIAHLQRFSIQTSYISRTQGLVATVPDGTALRGSQTYTPICNTGSHIIQLAGSIHPEVNEAHFMYTHSPQRPGNKVLLPIHFQISDPPNFCGRNIRGWVHEELHVFPGR

SEQ ID NO: 874339 - protein, 51 aa, Homo sapiens
KSRECSASSGDPSEAFKLRRRSSAIPKRVESEQPRLQFKSCRILGPSSSLG

SEQ ID NO: 874340 - protein, 101 aa, Homo sapiens
MAASTSSTVACVMNPKPLECSVFGSLITTQSVSVPHCSKWLLRLSSVVLKLNPPMKSFLSCSGSLGDSDLDMTEGRRETLTMLLQWRPRAEKNKLMNVSHC

SEQ ID NO: 874341 - protein, 83 aa, Homo sapiens
MSPFLWLLSGYKPETGPITQDTHHQCLWPEQGHFQSKPSPESRGRGHEPQKHPGMSGHLATQSTGPTLAHPARAVDSVCHRTP

SEQ ID NO: 874342 - protein, 293 aa, Homo sapiens
GARSGALMTRKGRGMQEVEELSETGKVVKQHRVGEALRVVVLVWAGSLGVDEAWFWVGGGYYGAVPAVEMPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARHVSASARGILEEQGGLAW

SEQ ID NO: 874343 - protein, 35 aa, Homo sapiens
RTLNTEPILVKVFKQIEDDGILLNLFYKARITEIP

SEQ ID NO: 874344 - protein, 124 aa, Homo sapiens
RWLTPVIPALWEAEVGGSRGQEIETVLVNTVKPCLYYKYKKLAWRGGGYLQSQLLGRLRQENGMNLGGTGCSEPRSQPLHSSLDNRARLCLKNKTKKPYFHIQSHWDLELQHMNFQGYHSVQST

SEQ ID NO: 874345 - protein, 499 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 874346 - protein, 528 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERWLLSPFFFQLSSFPTFSPSLSPTLLSFISDEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 874347 - protein, 479 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 874348 - protein, 271 aa, Homo sapiens
MFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 874349 - protein, 268 aa, Homo sapiens
MRDITCYLVAELFAGDNGDLLAHALVRVEVVAQARVVLFYDDPGRLLHGFGANAAHVARVKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 874350 - protein, 499 aa, Homo sapiens; identical to SEQ ID NO: 874345

SEQ ID NO: 874351 - protein, 271 aa, Homo sapiens; identical to SEQ ID NO: 874348

SEQ ID NO: 874352 - protein, 499 aa, Homo sapiens; identical to SEQ ID NO: 874345

SEQ ID NO: 874353 - protein, 479 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQVSDGMSYLTAWHSSTWFLCFLLRTCLLSSPHCLPSWQLILSMPFSVPCSLFDLIESMLEYEPAKRLTLGEALQHPFFARLRAEPPNKLWDSSRDISR

SEQ ID NO: 874354 - protein, 386 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLLWLFGD

SEQ ID NO: 874355 - protein, 55 aa, Homo sapiens
QDTEPQNPMGSQRRSPEEEAGPYLEGLPLISSETRGAVGGEDRRCLETLAPQRCL

SEQ ID NO: 874356 - protein, 231 aa, Homo sapiens
RRCQATGRRRQEGTAGCRFLSPWSRAAPPRRRPRWVRGLSGAVGQALSRPPRALSRPRRSRAALRAACERDSREAPGRRTHSFPLGTPAGARLSLLWPAWASQAPSRLSPEQEPHLGPPLSHLPWVWYAPLCRTPRPPAWEEARTPGRPGHSCGLCQFHSSTWALSTVSHWAARGTPAASPGPLQGRGRLGSPGRPAPRRACLLSSCPSGLCWPGGSKMQGRRELGGEPLS

SEQ ID NO: 874357 - protein, 138 aa, Homo sapiens
SRCAWREQGADTGVQAGTRIKWKWWRWGERGRLGDTVEAEASGPGEGLDTALGQVPHGRAEGRGSSGQLEEAGDVHQDQRQNSFTRKGHSSPKKTGKLLWPFVQPKAHTPTSKLASNLHSTLQSTLCQKHLWPLHLLR

SEQ ID NO: 874358 - protein, 110 aa, Homo sapiens
HYSHVVTSPFKYLLKFYLVSKRIKNQERHTGEETSSHESSLLQREMTNSVSTLSEKTCQPPKATVPSLWRNSFENLMKALPLSGKVSVCTETQNTPWNFKRVKGPLKLTH

SEQ ID NO: 874359 - protein, 82 aa, Homo sapiens
MAPLFTTHPTGSWGHRDEGHKLVASLQTNALHVDPLHLRMASGEDQWQKALKASLLQAEVLGVGLGMSEGLEGQDSPLPGAE

SEQ ID NO: 874360 - protein, 68 aa, Homo sapiens
MQDPRHPQGLPLSPGLPKRQRQDRTIYNWKQQEVLENHFKEEQYPDYDTRQELAEMLNLREYQVQVWF

SEQ ID NO: 874361 - protein, 470 aa, Homo sapiens
SDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSPAPPLPQVF

SEQ ID NO: 874362 - protein, 1226 aa, Homo sapiens
SDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPWPGPCALLEEQAPPPDLGWGPCQLQHHPCPKSFNLGVSILKRPHRSSGL

SEQ ID NO: 874363 - protein, 1564 aa, Homo sapiens
SDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 874364 - protein, 1589 aa, Homo sapiens
SDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 874365 - protein, 301 aa, Homo sapiens
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 874366 - protein, 280 aa, Homo sapiens
MEDEVVRFAKKMDKMVQKKNASTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 874367 - protein, 180 aa, Homo sapiens
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYRNG

SEQ ID NO: 874368 - protein, 301 aa, Homo sapiens; identical to SEQ ID NO: 874365

SEQ ID NO: 874369 - protein, 301 aa, Homo sapiens; identical to SEQ ID NO: 874365

SEQ ID NO: 874370 - protein, 155 aa, Homo sapiens
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSQYRHIFILKVIVLLPASIPLSNVPLFTLLFLFSNQMEVVNVCSHVF

SEQ ID NO: 874371 - protein, 312 aa, Homo sapiens
MGSPLTSDLQSVGSACTSRAVFDCRCLGRRSRAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 874372 - protein, 238 aa, Homo sapiens
MEDESLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 874373 - protein, 301 aa, Homo sapiens; identical to SEQ ID NO: 874365

SEQ ID NO: 874374 - protein, 78 aa, Homo sapiens
LHSGWQEHHLKEMRKNLTKEAIREHQMAKTGGTQTDLFTCGKCKKKNCTYTQVQTRSADEPMTTFVVCNECGNRWKFC

SEQ ID NO: 874375 - protein, 127 aa, Homo sapiens
VQQLKLLLRPDASLQAATDILFREVGLAGGHPLIGQLAHGSGCIGHQGQIGGVSAVQGFPAEVEAQEAGIDACKGLPSRRGGMQEVQGGTNEPAIGRQEAGSGYLVVPLQVPGEHLHQVVTLSWCGR

SEQ ID NO: 874376 - protein, 112 aa, Homo sapiens
MAKWGCEPLAQRLHPRLEVILHVPKQAMPRSAKKSGQPGHECTPRSPGNFIQDTTQPVLQPAGHRLPQLSRATTTLTEVSQEATLDTGRQQGMERGKEGGKTPSCGRVAKDG

SEQ ID NO: 874377 - protein, 318 aa, Homo sapiens
LKACGSRLTEKLLEGAPTEDTLVQMEKLADLEEESESWDNSEAEEEEKAPVLPESTEGRELTQGPAESSSLSGCGSWQPRKLPVFKSLRHMRQVLGAPSFRMLAWHVLMGNQVIWKSRDVDLVQSAFEVLRTMLPVGCVRIIPYSSQYEEAYRCNFLGLSPHVQIPPHVLSSEFAVIVEVHAAARSTLHPVGCEDDQSLSKYEFVVTSGSPVAADRVGPTILNKIEAALTNQNLSVDVVDQCLVCLKEEWMNKVKVLFKFTKVDSRPKEDTQKLLSILGASEEDNVKLLKFWMTGLSKTYKSHLMSTVRSPTASESRN

SEQ ID NO: 874378 - protein, 137 aa, Homo sapiens
LKACGSRLTEKLLEGAPTEDTLVQMEKLADLEEESESWDNSEAEEEEKAPVLPESTEGRELTQGPAESSSLSGCGSWQPRKLPVFKSLRHMRQVLGAPSFRMLAWHVLMGNQVIWKSRDVDLVQSAFEVLRVRTSFP

SEQ ID NO: 874379 - protein, 318 aa, Homo sapiens; identical to SEQ ID NO: 874377

SEQ ID NO: 874380 - protein, 195 aa, Homo sapiens
SESCCPPQTMLPVGCVRIIPYSSQYEEAYRCNFLGLSPHVQIPPHVLSSEFAVIVEVHAAARSTLHPVGCEDDQSLSKYEFVVTSGSPVAADRVGPTILNKIEAALTNQNLSVDVVDQCLVCLKEEWMNKVKVLFKFTKVDSRPKEDTQKLLSILGASEEDNVKLLKFWMTGLSKTYKSHLMSTVRSPTASESRN

SEQ ID NO: 874381 - protein, 50 aa, Homo sapiens
MLSEGLGSVPYSWAAFSNPGSIALSSGPSRSSPTWAGVAKLFQYCWQQHS

SEQ ID NO: 874382 - protein, 129 aa, Homo sapiens
AWATEPDSITKKNKNKQTKTNPPRALSSLGKSQVLTRAFVVPHESLPAASSITPLTTHGPLLTPLETRRSPFCFCLRTFALAVFQPERLLLPLVPPGLDSNVILPVKSFHLGSFYPSFLLSFCFILHCT

SEQ ID NO: 874383 - protein, 108 aa, Homo sapiens
GREVLSVSVLMTSTTQEGSIRHKAEFLEMNKYGGQNQHFLTRELNNRETCKTDNTSQKKNRREEKMREKLQDAWKRCRKSNIPCGAYRTYRERCRRRNHQRDHRRKMS

SEQ ID NO: 874384 - protein, 111 aa, Homo sapiens
TSCDWQSVKQSPLGLLQRKLADPGYAQGEAPEMFRRYLCWLLGGRFDGEQGEHACSSTVFFLLTGPQNSVSLFLFPRAVSSCWNLLSLSLLGTPQREAWPSIPPPPAPKTG

SEQ ID NO: 874385 - protein, 70 aa, Homo sapiens
GSLGPGQRHLQKEDLLPWDSARLEAQRLQSTGLGAGKELGGQGVEALPTVIADGPGPTHHTPAWCPPAWP

SEQ ID NO: 874386 - protein, 114 aa, Homo sapiens
MVMEGPRYLSPNCPDLLSENPLHALLPHKIKREKKTSAVHGQSQSGTCNSPDLMCFMTLVIGHTGICIPPCAPGRAELFAKYLIQEACNLGLEAVRPGFCYLAKLFQGFWSTHS

SEQ ID NO: 874387 - protein, 113 aa, Homo sapiens
MKPTRVQIQESIWGSSSFFSTNHYFYLIYAHLKAPVRAPLGLGARFSLGSSITYVCYWARLSVPTLCIRSYRLSPLYPLHFLGFPPSGAWASIDVSLHLPVILLSPGGVIFLN

SEQ ID NO: 874388 - protein, 208 aa, Homo sapiens
MNMEIGHPHEGKDDLGDKRVIMGTKFPMELGIRVGLGKEDSRCGESPVVSNKCEGRMAPPETKFPLSKGLEMGLERQNISRTVMQRGSLGVDSVSASQGTKPSLLPGRMGLENESLLAGYTHERIIQPPLGRVCGSSQAAGSRRAPLASGPEGVEELVGKPAFVMEPRQEMEKESTCVLMKPNTEIKLPVEVDIGLTQAEGPDETKNT

SEQ ID NO: 874389 - protein, 69 aa, Homo sapiens
CLEFTIIHSTLWDAVSVSYHYLGYMTVSPNQTLLVIQEVYKHLSGATNLSRYKLEVLVTVSASVSSTWR

SEQ ID NO: 874390 - protein, 280 aa, Homo sapiens
QQEYLENHIQTQSSALDRVNAMNSALASDSMGGQKTLVDVTLENSNINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 874391 - protein, 568 aa, Homo sapiens
RRRGGSRSPESGRVAEEMPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 874392 - protein, 121 aa, Homo sapiens [sequence omitted]

SEQ ID NO: 874393 - protein, 145 aa, Homo sapiens
MQVFLRPRELSRESGWGGGFFYAHFPLLCHSFHSLSSLQPNPQTLSLVNSRLLGASESWFVNPRCPFWPYHQQPKQVARRVHMCLEGKDPSGARKVGKWGSSPHLPGIDPLSWLPGCVRGWEGPYIIWLHLLWFLIALHSEMKRL

SEQ ID NO: 874394 - protein, 145 aa, Homo sapiens; identical to SEQ ID NO: 874393

SEQ ID NO: 874395 - protein, 106 aa, Homo sapiens
MSNVTQLLPALPSNPERQQWRKPLNGTSQAALLRAPHGQTRQHPQPGLSQGGPCSQQQSHRTCEGTMDTELGTLATSRGHSGSQEAMLCFFSFPPSLSFLLSPIPF

SEQ ID NO: 874396 - protein, 105 aa, Homo sapiens
MHSARAAPNLTQQSDGLMPICWMVRLRWREGQATSLGSPAGGSLGALPLRTFCARWELPDFCTPRLRSGRKQQEDSCRPLEPRAHPGGKGGGRCWFWLSPSPTSS

SEQ ID NO: 874397 - protein, 70 aa, Homo sapiens
LVAAGVVVVVVSTGGIGVVPGVEEGLVVEPVAVIVVAVVVSDGGVPLVCVLEEGVAIEPVATVVVVVVST

SEQ ID NO: 874398 - protein, 133 aa, Homo sapiens
CVCKRASERDASRCDDVNILWVYTSGPFCLHFYYNIVLTLHFTVRHLRPLHSCALLPAVSPVFFGSLLEMWAPQSIWSHLPPNTSTSRGLVLWEWAGPYEKHLAPTEDNDIMWGQVRCPPSHTIAQLPWALQV

SEQ ID NO: 874399 - protein, 827 aa, Homo sapiens
RLRAGDNRCWVSQGLRQDGTPLTPSLSALRFPAWWPQDVPVAWQSATDDAYEALSPSSCAFAMAFVCAGLSEVSIHCAQAGMQSCCIWNWWVLGLTDFKNEAADPQCTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 874400 - protein, 743 aa, Homo sapiens
SRRQEKMNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 874401 - protein, 222 aa, Homo sapiens
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKAPRELE

SEQ ID NO: 874402 - protein, 235 aa, Homo sapiens
RGVRREPRETWLLVLFRRRGMATSSRSPVGRGAEGITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKAPRELE

SEQ ID NO: 874403 - protein, 855 aa, Homo sapiens
RLRAGDNRCWVSQGLRQDGTPLTPSLSALRFPAWWPQDVPVAWQSATDDAYEALSPSSCAFAMAFVCAGLSEVSIHCAQAGMQSCCIWNWWVLGLTDFKNEAADPQCTMSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 874404 - protein, 771 aa, Homo sapiens
SRRQEKMNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 874405 - protein, 855 aa, Homo sapiens; identical to SEQ ID NO: 874403

SEQ ID NO: 874406 - protein, 162 aa, Homo sapiens
MYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 874407 - protein, 90 aa, Homo sapiens
REQQPKCDCNFWQLQIPKTTRKGKGTLQGSSRKNVSPKKTTASGKPEEGSGPTVSCHCDQLNEELHQNEPQLDQNSEETSTFFSVSLSSQ

SEQ ID NO: 874408 - protein, 129 aa, Homo sapiens
MDPWQSLLGTESGGEAERLGQLWPADSSCRREAVSPASQCTLREKNKWQKELELAFEELFNINRKLKKHLCLYLALKPRMDQRPGEGHAFSEMQECGAGTPRGKKMADPEMLPAGEPRSPAEEEAQQAA

SEQ ID NO: 874409 - protein, 142 aa, Homo sapiens
PGSHAESFLSLLLSSDQPPSCVHCPHTHRNTDCRQGGALPASQRVFPMPNSGWHMAALSKYCLDYDIDELPGTLSAPLHSFPCLSWDPGHCQPDFQCSLLPDYKQDLFKMHEQFCHPLPSGSSWLLLAQGRALTPPRPLSSG

SEQ ID NO: 874410 - protein, 38 aa, Homo sapiens
RSVTLYSNELTQCSKYSLLIGAQEEQELSTDAQPCTSL

SEQ ID NO: 874411 - protein, 132 aa, Homo sapiens
VLRQTFTLVAQAGVQWHDLSSLQPPPPGFKRFSYLSLPSSWDYRHAPPRPANFVFLVETGFLHVGQADLELSTSGDPPTSASQSAGITGMSHHAQPKCPPFKAEICLLTTPAPILLSVFQKSKSTSNLLLFP

SEQ ID NO: 874412 - protein, 111 aa, Homo sapiens
LCPVGLSTDLSSLPRYSMLLSPSRTGFLKHLVASLLSPVYYSCLWLHPPFSLGLPVPLTLQAWLLVTIMTMIITMTITAHTMCYLHAKNSTNHFVLINCFLLPAPLEGRRY

SEQ ID NO: 874413 - protein, 40 aa, Homo sapiens
MHSPSHGTAASPTHLLPHKRAPNTLSHLGARSQLPAVTHC

SEQ ID NO: 874414 - protein, 816 aa, Homo sapiens
MGMASKNMAPAASVPFSSMVSTALCTALESFRGASSVTPEEVSPIAEDLSDAQLTQDALQIKVPVMDSLGKCKLADLLSSFSRNLVMISWVSSFSRCCSFPSSGRKKMAVALPRYFISSTQLDSFLQCWMLNMPKRFIIGTFTVVTWSTWKSSSSVSLTSKGLSHFAFKEDVIHQSKNCVSVKLLDQIHNFPLSTLLHVIVDLFLGLFGVPEVDSEGFCVVQLFNILQKLIHQLQALAEEQAIAGGQLELAVWLVEGTEEFLEAFMDLSLRNLREVEIQALQDFIVSVSLGPQGEHCKGCSDAHWGEEDIGAVGLVCQLAVEAEGELSQVGGDLVEGWVILIMVGCICLLGSISLGILSQGDRDQAAQACQQEDAPRDRRRHCQIHCPRSVVVPEAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKS

SEQ ID NO: 874415 - protein, 647 aa, Homo sapiens
MGMASKNMAPAASVPFSSMVSTALCTALESFRGASSVTPEEVSPIAEDLSDAQLTQDALQIKVPVMDSLGKCKLADLLSSFSRNLVMISWVSSFSRCCSFPSSGRKKMAVALPRYFISSTQLDSFLQCWMLNMPKRFIIGTFTVVTWSTWKSSSSVSLTSKGLSHFAFKEDVIHQSKNCVSVKLLDQIHNFPLSTLLHVIVDLFLGLFGVPEVDSEGFCVVQLFNILQKLIHQLQALAEEQAIAGGQLELAVWLVEGTEEFLEAFMDLSLRNLREVEIQALQDFIVSVSLGPQGEHCKGCSDAHWGEEDIGAVGLVCQLAVEAEGELSQVGGDLVEGWVILIMVGCICLLGSISLGILSQGDRDQAAQACQQEDAPRDRRRHCQIHCPRSVVVPEAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHAEAGEWREPRRRSLQ

SEQ ID NO: 874416 - protein, 304 aa, Homo sapiens
TLAGSPFPARTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKS

SEQ ID NO: 874417 - protein, 204 aa, Homo sapiens
MESPKQLSDLKTLNELLVFISPFLLWGFGQCVEDSCLLPGGQTSGKWCLVVSFFFFFFFGGEGELSPLSVSPPEGVDVSKGLPPWASTCNLPTSRGIPRGLESLSRSVAVGLAICVRPTNAKRYNFGGFLEIEKMGESRAKCVASERGGPEKISVHLGDVYSRLAFGTFPKRVLGQFVPGGVIAPGVPQGVGCSGRLNRQCAHA

SEQ ID NO: 874418 - protein, 247 aa, Homo sapiens
LWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIIKHCWKPVMQKCPWLIPDCTRLDITFTN

SEQ ID NO: 874419 - protein, 110 aa, Homo sapiens
TRVLQCAPRCSPNCVAFTAAVTVPACIYALFGPCEHTGILVILPPMEYFMALPCVYLFGYKPLITHFNTLDKVQSKKIQKRILASYVPKEKNKGDNANMLNNKGFFFLFV

SEQ ID NO: 874420 - protein, 76 aa, Homo sapiens
MTRDTVCQCKEGTFRNENSPEMCRKCSRCPSGEVQVSNCTSWDDIQCVEEFGANAILLPILSLTRNMLNAAPIQFS

SEQ ID NO: 874421 - protein, 243 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874422 - protein, 243 aa, Homo sapiens; identical to SEQ ID NO: 874421

SEQ ID NO: 874423 - protein, 243 aa, Homo sapiens; identical to SEQ ID NO: 874421

SEQ ID NO: 874424 - protein, 307 aa, Homo sapiens
MVCEKTTEGEDEAPFQEKDSGSDEDFLMEDDDDSDYGSSKKKNKKMVKKSWSLASRLGPVSTANMSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874425 - protein, 243 aa, Homo sapiens; identical to SEQ ID NO: 874421

SEQ ID NO: 874426 - protein, 243 aa, Homo sapiens; identical to SEQ ID NO: 874421

SEQ ID NO: 874427 - protein, 243 aa, Homo sapiens; identical to SEQ ID NO: 874421

SEQ ID NO: 874428 - protein, 243 aa, Homo sapiens; identical to SEQ ID NO: 874421

SEQ ID NO: 874429 - protein, 202 aa, Homo sapiens
AGAYRWGGTGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874430 - protein, 202 aa, Homo sapiens
MERLIGSGRMKQFKEDREDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874431 - protein, 190 aa, Homo sapiens
MPINLRPYCVNENLESLDGYTIEKDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874432 - protein, 106 aa, Homo sapiens
MEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874433 - protein, 168 aa, Homo sapiens
APASVFIQILKKKVEVVFFDGKSDPCRLRERKLHHTQRWGAPEGLWVLVDRLPGLHALLVLDPEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874434 - protein, 130 aa, Homo sapiens
SKHHSPMAAGDSGGERMNNKFDALKDDDMWGPCIRMKKTANKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874435 - protein, 243 aa, Homo sapiens; identical to SEQ ID NO: 874421

SEQ ID NO: 874436 - protein, 243 aa, Homo sapiens; identical to SEQ ID NO: 874421

SEQ ID NO: 874437 - protein, 243 aa, Homo sapiens; identical to SEQ ID NO: 874421

SEQ ID NO: 874438 - protein, 243 aa, Homo sapiens; identical to SEQ ID NO: 874421

SEQ ID NO: 874439 - protein, 243 aa, Homo sapiens; identical to SEQ ID NO: 874421

SEQ ID NO: 874440 - protein, 260 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPFQEKDSGSDEDFLLEDDDDSDYGSSTKETTKRLGETVHNPWKEDAATK

SEQ ID NO: 874441 - protein, 223 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKKNKKQKTPEALNSRGAGQKGVREGAKWAKRGPRRPQFPGHQGEKLRRRNPKKRERANKSAGKPPGTRD

SEQ ID NO: 874442 - protein, 294 aa, Homo sapiens
TVCEKTTEGEDEAPFQEKDSGSDEDFLMEDDDDSDYGSSKKKNKKMVKKSWSLASRLGPVSTANMSRPVRNRKVVDYSQFQESDDADEDYGRDSGPPTKKIRSSPREAKNKRRSGKNSQEDSVGLDCKTKDVETTESKDDLCTPGEEDSEDEKEDHKNVRQQRQAASKAASKQREMLMEDVGSEEEQVHDGTDAGQPFQEKDSGSDEDFLLEDDDDSDYGSSNLCKIRSSPKRHTWTVNLNYLAQRKRTIIMPVIEDARDPQEIPDAHRNGGCDLVLMWPARTDPDCGLNAQLL

SEQ ID NO: 874443 - protein, 127 aa, Homo sapiens
RLGARPGGGGAGGSSVPGALNQRAAEFEKPAARGSAAAVPSLLLPHSGPLLSTVHFHLSRPLLSLSLSVCLSAFISGFDPPLQALGPFFPLPSNLAAIGRKETLEHMWIYIRAPRGGGRAPRDGGRS

SEQ ID NO: 874444 - protein, 243 aa, Homo sapiens; identical to SEQ ID NO: 874421

SEQ ID NO: 874445 - protein, 243 aa, Homo sapiens; identical to SEQ ID NO: 874421

SEQ ID NO: 874446 - protein, 243 aa, Homo sapiens; identical to SEQ ID NO: 874421

SEQ ID NO: 874447 - protein, 156 aa, Homo sapiens
AAAYYYYYCSEFKLLTMYGVMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874448 - protein, 128 aa, Homo sapiens
TRCSLSSSPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 874449 - protein, 79 aa, Homo sapiens
PPHEERCPRLKATVTPSPVKGKGKVGRPTASKASKEKTPSPKEEDEEPESPPEKKTSTSPPPEKSGDEGSEDEAPSGED

SEQ ID NO: 874450 - protein, 243 aa, Homo sapiens; identical to SEQ ID NO: 874421

SEQ ID NO: 874451 - protein, 243 aa, Homo sapiens; identical to SEQ ID NO: 874421

SEQ ID NO: 874452 - protein, 243 aa, Homo sapiens; identical to SEQ ID NO: 874421

SEQ ID NO: 874453 - protein, 308 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSKIDSEFIFKFAHSTSKSLVNLPVSQRGQLFDTRKNLVERVKFTPKKAKAAPLEASAHTILKSNITDSQPIVIFT

SEQ ID NO: 874454 - protein, 177 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEGSREKKKRSYR

SEQ ID NO: 874455 - protein, 184 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKKKWPLEFFFFFFFFFFMITYLTAQFYTEC

SEQ ID NO: 874456 - protein, 32 aa, Homo sapiens
MEGFSVLPASGNKHLHVGPPITLKTTSRDEES

SEQ ID NO: 874457 - protein, 78 aa, Homo sapiens
QAGSRRKLHLRAGGALGRAGPARKCADRAGGLSGRHKALLVPTSCGLCHPMGASLKFQSITGTHPGPAAPGPRDRISC

SEQ ID NO: 874458 - protein, 52 aa, Homo sapiens
KRSCLGQEAAHGADASLAFFLNRVTHFSIPSTEYAKDLLKFGRYISILPDAN

SEQ ID NO: 874459 - protein, 132 aa, Homo sapiens
MLTAAVLSCALLLALPATRGAQMGLAPMEGIRRPDQALLPELPGLGLRAPLKKTTAEQAEEDLLQEAQALAEVLDLQDREPRSSRRCVRLHESCLGQQVPCCDPCATCYCRFFNAFCYCRKLGTAMNPCSRT

SEQ ID NO: 874460 - protein, 60 aa, Homo sapiens
NSCSRPPRLSLTVPHDKDCPSSFPRLNLISVSHNLEDTESSLLQPHTPCRDASCTLVPLL

SEQ ID NO: 874461 - protein, 105 aa, Homo sapiens
QSAGIIGVSHHTQPFLKLFLKHDLKDNFIFNRRELYNHLLAILLSPSHFFFEKSLALLPRLECSGAILVHRNLRLLGSSNSPASASRVAGIIGTHHHAQLIFVFL

SEQ ID NO: 874462 - protein, 342 aa, Homo sapiens
YNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 874463 - protein, 148 aa, Homo sapiens
GGPLRLKVWPALAMEKGMGERGPARPPVSWGSQGKNRMELGDTPAVQMRARWPRESSAVATAGSQGRSLRHSGRPMDSPDNPSAVGDFLGKSNRSLVCIAFPPFPEHLLCTGFMLGSVGRAINQICTPWLVRHAWWLKITKPRQLKCS

SEQ ID NO: 874464 - protein, 97 aa, Homo sapiens
PDVDHCRISDSEINSRWIKDFSIRPKTIKTLEENLGNTIQDIGMGEDFMTKTLKAMATKAKIDKWDLIKLKSFCTAEETIRVKGNLENGKNNCDLSI

SEQ ID NO: 874465 - protein, 82 aa, Homo sapiens
GEKPRQVGRLGRIPVRLPREVSQFGDSLRTGREAGGSRVGGESEEGDLPEEYRLVACTPELNAGGRENQAALPPSKGAPLEK

SEQ ID NO: 874466 - protein, 245 aa, Homo sapiens
MLAKVVEGDLAFKGGRDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVH

SEQ ID NO: 874467 - protein, 68 aa, Homo sapiens
MRRGSFFPKQGICGPKKGSKKPHFIIFSLSSCCLALHRDGHWKSQQSGATTGPCLVARRVKRTATGKL

SEQ ID NO: 874468 - protein, 695 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSRECPPTCPWYCQGPPAQGSQPLCPPAATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874469 - protein, 833 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSRECPPTCPWYCQGPPAQGSQPLCPPAATEGELPTHEQVFLQPPTSSKPRGPVLPQELEERRQLGKAPMGGVPWGSDGHQRWQGVPHHPHAVCHLLSPLLTSWATYLSLDGLCLMGDGPAQGPQECWAASEQVGDHWEQLIPGPCFARGRALLHSQLLTPVARTPNESGCDEPHSPGVAHSFCHVPGPTGPHGVGHPSAPRAGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874470 - protein, 670 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874471 - protein, 742 aa, Homo sapiens
MRTGAENLYRATSNNRVRETVALELSYVNSNLQLLKEELEELSGGVDPGRHGSEAVTVPMIPLGLKETKELDWSTPLKELISVHFGEDGASYEAEIRELEALRQVRLAYWGPGPAACPGLREGQRSLQHRCPPTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSRECPPTCPWYCQGPPAQGSQPLCPPAATEGELPTHEQVFLQPPTSSKPRGPVLPQELEERRQLGKAPMGGVPWGSDGHQRWQGVPHHPHAVCHLLSPLLTSWATYLSLDGLCLMGDGPAQGPQECWAASEQVGDHWEQLIPGPCFARGRALLHSQLLTPVARTPNESGCDEPHSPGVAHSFCHVPGPTGPHGVGHPSAPRAGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874472 - protein, 538 aa, Homo sapiens
GTKQQELRCQEAAGMVVGAGGGWVGRSRHHLESGRPSRACHIHRQVAAEYRLVHRTMAQPPVHDYVPVSWTALVHVKAEYFRSLAHYHVAMALCDGSPATEGELPTHEQVFLQPPTSSKPRGPVLPQELEERRQLGKAPMGGVPWGSDGHQRWQGVPHHPHAVCHLLSPLLTSWATYLSLDGLCLMGDGPAQGPQECWAASEQVGDHWEQLIPGPCFARGRALLHSQLLTPVARTPNESGCDEPHSPGVAHSFCHVPGPTGPHGVGHPSAPRAGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874473 - protein, 515 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLVSTPVPRHRPAWAAWAVWL

SEQ ID NO: 874474 - protein, 413 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSRECPPHLPMVLPRPPRAGLTASLSPSSDRGRAPHARAGLPAAPHLL

SEQ ID NO: 874475 - protein, 369 aa, Homo sapiens
ALGTQEPAAQVVRAALARLRSAARAAGWLTPRDPQRSGCGDDPGGEAGRHGVGLGSPVASLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQVHASALAPAGSKHRACPPHPEDLRAMPVPPHAGGCLGHLRCP

SEQ ID NO: 874476 - protein, 747 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLVSTPVPRHRPAWAAWAVWLCPAHGLRQAIDGGPALPTHLVEPHGVPRCTGWMDVLVRRGLLSVWPSWASDLSAPARGGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 874477 - protein, 515 aa, Homo sapiens; identical to SEQ ID NO: 874473

SEQ ID NO: 874478 - protein, 573 aa, Homo sapiens
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAGLKEGDYIVSGCTISVEHSRVEDPLTA

SEQ ID NO: 874479 - protein, 114 aa, Homo sapiens
TWGDGRTRGPVCPDPARGRGGAPRWLRCRMLLAFGSHGCPGPHWLCLPAPHGAGAHGTSQGSVCEWGGPGRWGPVAPALQAMRTPSRNESGLELLTAYYNQLCFLDARFLTPAR

SEQ ID NO: 874480 - protein, 127 aa, Homo sapiens
WVAMSWLYYCTLAWVTECDPVSNKIKKPSKLRQPGNSVCFLNWQKLKRTVLICPPSGGSLAAGKSSPGACTFQADRLPLQARGCPPLQARGCPPLQARGCPPLQAPGCPPLQAPGCLTSPSPNCLLL

SEQ ID NO: 874481 - protein, 163 aa, Homo sapiens
ARRRGALADGGERGGHRAGPAALELGLAGTLGQPRASVARASRACPRTRVRASPRTAAWLGGRPYSRRPSAAKGLGAQTRNRHLGLGRRHGQKPTGQPAPPHDSRMAIAQCRSRFASSLPFLLEFCSCRPGYRTTVALSPLTATSASQVQAILLPQPPTTTPG

SEQ ID NO: 874482 - protein, 37 aa, Homo sapiens
MKNLDFDFISSVEMICIYKIFFGSHINDWRRQKESQE

SEQ ID NO: 874483 - protein, 113 aa, Homo sapiens
MLGLVCGPQDLRRSQLQRGPKHGGRRRLKRNIAPVSSGGQSGTSSDDDSLGDPSSRQNQDLLREETGREPESTGGNMRPCSRWAAQLGRGDPGLDRLETLTFTKCWLAFQKRP

SEQ ID NO: 874484 - protein, 150 aa, Homo sapiens
CNLRLLGSSDSPASASHVPGITDARHRARLIFVFLVETRFHHVGQAGLELLTSGDPPTSASQSAGIIGVSHRAWPTSSASKGHSTLEECARRDGVLHSWDAEMLRVKRLGFGGTRLPGFRLSKGVFDFLDRRFFHFLWSGSLTWECGVWV

SEQ ID NO: 874485 - protein, 31 aa, Homo sapiens
MEGGVKRQNHSKFDLKLELAFIYNSRIMQHL

SEQ ID NO: 874486 - protein, 117 aa, Homo sapiens
GSGAQRIVKHIEISFVYFPLVHFPILSAWHRGYTESSSLEQSFNQGDKIGVWGYQRARGCRAEILRNIRGESNFFFFFLRQDLTVSPRLECSAVILAHCNLHLLGSSNSPASASQVA

SEQ ID NO: 874487 - protein, 123 aa, Homo sapiens
SPFHIIQNLSHQHLPPLLPKPCPLWPGWLPQPPPSPPSSYSLPFTSLCPHHHTPHSLTAAAGVRLTLQCKLTAAQLRSPQQLPITLRANPATLPWPSRLPVSWSLQASPIPLSLPLAVSYSLP

SEQ ID NO: 874488 - protein, 69 aa, Homo sapiens
PKMSLDIAKCPLGVKTATGSEPLAYWVRRGWGIGGSEDCKAHSCLSSSQPPWGWMGLERLLAALLAETC

SEQ ID NO: 874489 - protein, 1446 aa, Homo sapiens
EPCALTPGPSHLALTFLPSKPGARPQPEGASWDAGPGGAPSAWADPGEGGPSPMLLPEGLSSQALSTEAPLPATLEPRIVMGEETCQALLSPRAARTALRDQEGGHASPDPPPELCSQGDLSVPSPPPDPDSFFTPPSTPTKTTYALLPACGPHGDARDSEAELRDELLDSPPASPSGSYITADGDSWASSPSCSLSLLAPAEGLDFPSGWGLSPQGSMVDERELHPAGTPEPPSSESSLSADSSSSWGQEGHFFDLDFLANDPMIPAALLPFQGSLIFQVEAVEVTPLSPEEEEEEAVADPDPGGDLAGEGEEDSTSASFLQSLSDLSITEGMDEAFAFRDDTSAASSDSDSASYAEADDERLYSGEPHAQATLLQDSVQKTEEESGGGAKGLQAQDGTVSWAVEAAPQTSDRGAYLSQRQELISEVTEEGLALGQESTATVTPHTLQVAPGLQVEVATRVTPQAGEEETDSTAGQESAAMAMPQPSQEGISEILGQESVTAEKLPTPQEETSLTLCPDSPQNLKEEGGLDLPSGRKPVAAATIVPRQAKEDLTLPQDSAMTPPLPLQDTDLSSAPKPVAAATIVSQQAEEGLTLPQDSVMTPPLPLQDTELSSAPKPVAAATLVSQQAEEGLTLPQDSAMTPPLPLQDTDLSSAPKPVAAATLVSQQAEEGLTLPQDSAMTPPLPLQDTDLSSAPKPVAAATLVSQQAEEGLTLPQDSAMTPPLPLQDTDLSSAPKPVAAATIVSQQAEEGLTLPQDSAMTPPLPLQDTDLSSAPKPVAAATIVSQQAEEGLTLPQDSAMTPPLPLQDTDLSSAPKPVAAATPVSQQAEEGLTLPQDSAMTPPLPLQDTDLSSAPKPVAAATPVSQQAEEGLTLPQDSAMTAPLPLQDTGPTSGPEPLAVATPQTLQAEAGCAPGTEPVATMAQQEVGEALGPRPAPEEKNAALPTVPEPAALDQVQQDDPQPAAEAGTPWAAQEDADSTLGMEALSLPEPASGAGEEIAEALSRPGREACLEARAHTGDGAKPDSPQKETLEVENQQEGGLKPLAQEHGPRSALGGAREVPDAPPAACPEVSQARLLSPAREERGLSGKSTPEPTLPSAVATEASLDSCPESSVGAVSSLDRGCPDAPAPTSAPTSQQPEPVLGLGSVEQPHEVPSVLGTPLLQPPENLAKGQPSTPVDRPLGPDPSAPGTLAGAALPPLEPPAPCLCQDPQEDSVEDEEPPGSLGLPPPQAGVQPAAAAVSGTTQPLGTGPRVSLSPHSPLLSPKVASMDAKDLALQILPPCQVPPPSGPQSPAGPQGLSAPEQQEDEDSLEEDSPRALGSGQHSDSHGESSAELDEQDILAPQTVQCPAQAPAGGSEETIAKAKQSRSEKKARKAMSKLGLRQIQGVTRITIQKSKNILFVIAKPDVFKSPASDTYVVFGEAKIEDLSQQVHKAAAEKQPQ

SEQ ID NO: 874490 - protein, 1422 aa, Homo sapiens
EPCALTPGPSHLALTFLPSKPGARPQPEGASWDAGPGGAPSAWADPGEGGPSPMLLPEGLSSQALSTEAPLPATLEPRIVMGEETCQALLSPRAARTALRDQEGGHASPDPPPELCSQGDLSVPSPPPDPDSFFTPPSTPTKTTYALLPACGPHGDARDSEAELRDELLDSPPASPSGSYITADGDSWASSPSCSLSLLAPAEGLDFPSGWGLSPQGSMVDERELHPAGTPEPPSSESSLSADSSSSWGQEGHFFDLDFLANDPMIPAALLPFQGSLIFQVEAVEVTPLSPEEEEEEAVADPDPGGDLAGEGEEDSTSASFLQSLSDLSITEGMDEAFAFRDDTSAASSDSDSASYAEADDERLYSGEPHAQATLLQDSVQKTEEESGGGAKGLQAQDGTVSWAVEAAPQTSDRGAYLSQRQELISEVTEEGLALGQESTATVTPHTLQVAPGLQVEVATRVTPQAGEEETDSTAGQESAAMAMPQPSQEGISEILGQESVTAEKLPTPQEETSLTLCPDSPQNLKEEGGLDLPSGRKPVAAATIVPRQAKEDLTLPQDSAMTPPLPLQDTDLSSAPKPVAAATIVSQQAEEGLTLPQDSVMTPPLPLQDTELSSAPKPVAAATLVSQQAEEGLTLPQDSAMTPPLPLQDTDLSSAPKPVAAATLVSQQAEEGLTLPQDSAMTPPLPLQDTDLSSAPKPVAAATLVSQQAEEGLTLPQDSAMTPPLPLQDTDLSSAPKPVAAATIVSQQAEEGLTLPQDSAMTPPLPLQDTDLSSAPKPVAAATIVSQQAEEGLTLPQDSAMTPPLPLQDTDLSSAPKPVAAATPVSQQAEEGLTLPQDSAMTPPLPLQDTDLSSAPKPVAAATPVSQQAEEGLTLPQDSAMTAPLPLQDTGPTSGPEPLAVATPQTLQAEAGCAPGTEPVATMAQQEVGEALGPRPAPEEKNAALPTVPEPAALDQVQQDDPQPAAEAGTPWAAQEDADSTLGMEALSLPEPASGAGEEIAEALSRPGREACLEARAHTGDGAKPDSPQKETLEVENQQEGGLKPLAQEHGPRSALGGAREVPDAPPAACPEVSQARLLSPAREERGLSGKSTPEPTLPSAVATEASLDSCPESSVGAVSSLDRGCPDAPAPTSAPTSQQPEPVLGLGSVEQPHEVPSVLGTPLLQPPENLAKGQPSTPVDRPLGPDPSAPGTLAGAALPPLEPPAPCLCQDPQEDSVEDEEPPGSLGLPPPQAGVQPAAAAVSGTTQPLGTGPRVSLSPHSPLLSPKVASMDAKDLALQILPPCQVPPPSGPQSPAGPQGLSAPEQQEDEDSLEEDSPRALGSGQHSDSHGESSAELDEQDILAPQTVQCPAQAPAGGSEETIAKANLMSSRAQPQTLMWSLARPRLRTCPSKCTKPQLRSLRCPQSPQPWSLSQHPGPG

SEQ ID NO: 874491 - protein, 1522 aa, Homo sapiens
EPCALTPGPSHLALTFLPSKPGARPQPEGASWDAGPGGAPSAWADPGEGGPSPMLLPEGLSSQALSTEAPLPATLEPRIVMGEETCQALLSPRAARTALRDQEGGHASPDPPPELCSQGDLSVPSPPPDPDSFFTPPSTPTKTTYALLPACGPHGDARDSEAELRDELLDSPPASPSGSYITADGDSWASSPSCSLSLLAPAEGLDFPSGWGLSPQGSMVDERELHPAGTPEPPSSESSLSADSSSSWGQEGHFFDLDFLANDPMIPAALLPFQGSLIFQVEAVEVTPLSPEEEEEEAVADPDPGGDLAGEGEEDSTSASFLQSLSDLSITEGMDEAFAFRDDTSAASSDSDSASYAEADDERLYSGEPHAQATLLQDSVQKTEEESGGGAKGLQAQDGTVSWAVEAAPQTSDRGAYLSQRQELISEVTEEGLALGQESTATVTPHTLQVAPGLQVEVATRVTPQAGEEETDSTAGQESAAMAMPQPSQEGISEILGQESVTAEKLPTPQEETSLTLCPDSPQNLKEEGGLDLPSGRKPVAAATIVPRQAKEDLTLPQDSAMTPPLPLQDTDLSSAPKPVAAATIVSQQAEEGLTLPQDSVMTPPLPLQDTELSSAPKPVAAATLVSQQAEEGLTLPQDSAMTPPLPLQDTDLSSAPKPVAAATLVSQQAEEGLTLPQDSAMTPPLPLQDTDLSSAPKPVAAATLVSQQAEEGLTLPQDSAMTPPLPLQDTDLSSAPKPVAAATIVSQQAEEGLTLPQDSAMTPPLPLQDTDLSSAPKPVAAATIVSQQAEEGLTLPQDSAMTPPLPLQDTDLSSAPKPVAAATPVSQQAEEGLTLPQDSAMTPPLPLQDTDLSSAPKPVAAATPVSQQAEEGLTLPQDSAMTAPLPLQDTGPTSGPEPLAVATPQTLQAEAGCAPGTEPVATMAQQEVGEALGPRPAPEEKNAALPTVPEPAALDQVQQDDPQPAAEAGTPWAAQEDADSTLGMEALSLPEPASGAGEEIAEALSRPGREACLEARAHTGDGAKPDSPQKETLEVENQQEGGLKPLAQEHGPRSALGGAREVPDAPPAACPEVSQARLLSPAREERGLSGKSTPEPTLPSAVATEASLDSCPESSVGAVSSLDRGCPDAPAPTSAPTSQQPEPVLGLGSVEQPHEVPSVLGTPLLQPPENLAKGQPSTPVDRPLGPDPSAPGTLAGAALPPLEPPAPCLCQDPQEDSVEDEEPPGSLGLPPPQAGVQPAAAAVSGTTQPLGTGPRVSLSPHSPLLSPKVASMDAKDLALQILPPCQVPPPSGPQSPAGPQGLSAPEQQEDEDSLEEDSPRALGSGQHSDSHGESSAELDEQDILAPQTVQCPAQAPAGGSEETIAKAKQSRSEKKARKAMSKLGLRQIQGVTRITIQKSKNILFVIAKPDVFKSPASDTYVVFGEAKIEDLSQQVHKAAAEKFKVPSEPSALVPESAPRPRVRLECKEEEEEEEEEVDEAGLELRDIELVMAQANVSRAKAVRALRDNHSDIVNAIMELTM

SEQ ID NO: 874492 - protein, 1522 aa, Homo sapiens; identical to SEQ ID NO: 874491

SEQ ID NO: 874493 - protein, 114 aa, Homo sapiens
VPLSTGLRILVGMAAPCRCGWTWVELVREARCLDLLMVTGLAVKAHLGSVSTPWSSHVSVTFQHWPDGGNLLRAHSPAPWHSRSQLSLIRTRCPLVRLLVIGFPSSPNVPVISH

SEQ ID NO: 874494 - protein, 101 aa, Homo sapiens
SRKVTQNTATLMFSLGFALLPRLKCNGAIIAYCSLNFLGSSDPPASASQSTGIIEPPAQTGVQWHEHSSLQPQPPGLECPSHFTLLSGWDYRCAPPQPIWG

SEQ ID NO: 874495 - protein, 74 aa, Homo sapiens
IVMSPRAKVQSSFTFLNSPQPKQEELVAPLCCPQPQNPLHVAPGLHRNPSYDADSLIHCLLLLRWGLLFPHGII

SEQ ID NO: 874496 - protein, 247 aa, Homo sapiens
RSFDSGALKASFSWALAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFAYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFIT

SEQ ID NO: 874497 - protein, 80 aa, Homo sapiens
MGLRREGQEQRWKQRTGLMPLSDVYWGEECRWWSRAIPGQEVLKRWPAEFAFPLSSSHPSLHRKTPVYGEALGWVGSGGE

SEQ ID NO: 874498 - protein, 114 aa, Homo sapiens
FSNYHYISLIRSMLFAPSLLIPPPTTNKHSIRVRVRCGTGGTEILSLISSTLTRLWLTRVTIQSSQKRGKGSTFLKKLSGINYITQCGTSLTSFACPNLRTCIRLRLSLKLGLK

SEQ ID NO: 874499 - protein, 104 aa, Homo sapiens
LAVGCGRRLNVPGIVAPLAEDASPAKEAGSRGSGVGSRHRQQLPDQPCCAQLPQAVTLNHHVTISGACQSPSTTCPPSCRGRKSSSPRGSVGPLHMGLRSGVGA

SEQ ID NO: 874500 - protein, 91 aa, Homo sapiens
VWVSHHSRHPGSLRPLVLLAQGLQPSSCPTKPLLARAFQGLGPGLEGGCFRFCQLPCLPTSSPSPGLGLTGHWFLSFPAPCPSGPHMSGPQ

SEQ ID NO: 874501 - protein, 184 aa, Homo sapiens
SGGDYRREPLCPAPATSFKTKSSQEFSFLGFLIFLLPSSLNPLHSGVCPHHSIETALIKVTEDLCTAKSSSLLSVLSLGKVAAFYPAGHFLPLETLSSLLLEYDAHLVFFLSLSLVLSPLQIPLYLSTSNVERHEGLVLEPTLFLYITNLVKSLILVVVNTVCMLHVQLDCNLDLFFFWATSPV

SEQ ID NO: 874502 - protein, 68 aa, Homo sapiens
MRSGKLLQNSVLSFEKARPGNRIKQKGRVGGQGLDLWGPNSVSKTYERNYHCIKNRREDLFFGVLVVS

SEQ ID NO: 874503 - protein, 41 aa, Homo sapiens
MPPSGLAPLTLPAPHPQVHLLAQTYGAWVHLDRAQLMNVVL

SEQ ID NO: 874504 - protein, 288 aa, Homo sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 874505 - protein, 264 aa, Homo sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGDKEDKEDKEGDPGGWRACQGHRPTVFRPLGSKLFPGHLQAMSTRPPVSVAGKGCVSTPRPSDPVLKVSLSL

SEQ ID NO: 874506 - protein, 117 aa, Homo sapiens
DLETEVERGGAGVTKHHSLLRTASVYACGPIIILKGALSNLRNVPARRINDLVSVATGLGQIPSSLSLLTCHPWGQVRKRISLSLYLGAAMHTHSHTPFFPDPGGTGEGQAVPRSTR

SEQ ID NO: 874507 - protein, 83 aa, Homo sapiens
HEAPAAGPVLQPEQSHYACFLIKGLASFLNSNKNTETCYYIRNIGRAQWLTPVIPALWEAKAGRLQGQEIETILANTVKPRLY

SEQ ID NO: 874508 - protein, 327 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 874509 - protein, 207 aa, Homo sapiens
MTENPFQERYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 874510 - protein, 66 aa, Homo sapiens
LLLIITSSDELSILYVHMDHNMLLYEFLDMTRVGSRVLQEMHDVASQFERRSYIGFLDILYWIKYA

SEQ ID NO: 874511 - protein, 247 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGKLKRVCKLKFFVLVDIFKILKYCLNII

SEQ ID NO: 874512 - protein, 216 aa, Homo sapiens
MQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 874513 - protein, 306 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNNHIMHDVIVTNLFFGFFLFFETGSRSAAQAVQWLNYDLLQP

SEQ ID NO: 874514 - protein, 230 aa, Homo sapiens
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIHLLGFRWFQKGSLDWAQFHTKGNIAI

SEQ ID NO: 874515 - protein, 109 aa, Homo sapiens
SVDPFPTQRWWGCGLGGESCRGPWTSAALDPLCSQLHPVPWGPKTCPVLQMNEKHKHRQDLKQHRTVCNPKSGMCYGQWPMAWVILRVQGRQALPKEAAGRMCLIQSWY

SEQ ID NO: 874516 - protein, 110 aa, Homo sapiens
MGSRRFTCCAAEPRLPSMMCPCGGIIGKQPFSDSQRTNELQKEIRQGRIAFGEKPLTRLALVFANNVSLNCCQIFFSLCRIHQSSYAKEHHCTALLKIHTIKWTLTCKKK

SEQ ID NO: 874517 - protein, 156 aa, Homo sapiens
TAQDARPFLGRPRRPRPKLHPFPPPCRAPEALWRLRARTKGGPCKRTCSAGSAGPTKRPGRIRVPGAAAPPCGRGGAAQGNAGGARVWNGLGTSPPRGRVRRQGVWRPGRVTPQPSRCLGSGFLCFAVYSSAPRSCLRCTRRFANVLSFLYNPSRQ

SEQ ID NO: 874518 - protein, 173 aa, Homo sapiens
DSGAAGLCGVDSGAAGLCGVDSGAAGLCGVDSGAAGLCGVDSGAAGLCGVDSGAAGLCGVDSGAAGLCGVDSGAAGRCGVDSGAAGLCGVDRQWSSWAVWCSQLLLGCFSCCFRPKFGQCVTVLNNVGSCNTTASICVSKHRKGDVLCSDVTMATTSLAIGICQFCYNFMEPL

SEQ ID NO: 874519 - protein, 140 aa, Homo sapiens
DSGAAGLCGVDSGAAGLCGVDSGAAGLCGVDSGAAGLCGVDSGAAGLCGVDSGAAGLCGVDSGAAGLCGVDSGAAGRCGVDSGAAGLCGVDRQWSSWAVWCSQLLLGCFSCCFRPKFGQCVTVLNNVGSCNTTASICVSQ

SEQ ID NO: 874520 - protein, 81 aa, Homo sapiens
ITLRAGRCSEGPSQGQGQEAWAEPSPYADGQPVTSHKPRGFLGRISIVTGHWVCRHTSPDFLLFYSLAEHPSPACWLPGTE

SEQ ID NO: 874521 - protein, 33 aa, Homo sapiens
MIRRILLGRPGRGEGAGAEWRGQRAGAATGAGA

SEQ ID NO: 874522 - protein, 51 aa, Homo sapiens
WKGASAACTCKKVGPNCPSLHRTTASQQQRPDKLQSCLLRTGERGSALSPF

SEQ ID NO: 874523 - protein, 248 aa, Homo sapiens
PRGSGAAQDSPSPGSRPCLGGASGSRSRALGLSPQARLARRSPQCREDPEDAPQAALLRASSQGPGMRRCRRCARWPHRCPGPQSGPRSHFSPWPRTLGPAPALCVRTPLRPGPSSALGPLSACPSVPDYTASPPAGDSARSIVAASRAAGSGSTPGAGSKDCSPPPHSHSAAAAGESGDIGPGSGAVEAPGRGARRPTRQREDGGGAVGCFGVSRHRGREAQMSHSSHCGSRSCSAAAARPSLLQLA

SEQ ID NO: 874524 - protein, 111 aa, Homo sapiens
NESLPEIMPHCNHALLGLSDPPASASLKVHLHLNKDGCAPRYVFVGFHPIVLEQRTNGRKLLKKRRAFLWLLQEQLQISVLKPGGNMWPRSHSGELQCSLLGISVLIWIQG

SEQ ID NO: 874525 - protein, 110 aa, Homo sapiens
PTSSDRGRREAQVSWLIRSEVQEAGPVLLVLVGAPTSPTGGCLGPPVTCRWLVRAALVGFLSPSLRTMGTLALTGQSSNPRLSLPLARVLCCGRGPFSTHLWLLLSPTHL

SEQ ID NO: 874526 - protein, 76 aa, Homo sapiens
SDRGGANGRDGLGTERPLWLLGGCGMMGEWTRRGILGMWSLKASRAVPQARDEWGEVKAEDAELGVIRISAECLMC

SEQ ID NO: 874527 - protein, 105 aa, Homo sapiens
GVRGSPVLPAVSPHRDPHPSPVHLTESYQWGPPTAFKYPPFTPCPGADKPSPSWAGLQAPMWGTAGFRGGTRGGTPVHLSLRGYTGILLSPGESEAAPQREQDPS

SEQ ID NO: 874528 - protein, 69 aa, Homo sapiens
ATSPIHIQSQKPFTPTNAQRPPQQPSTPHTTTTFTHMHPMTKVLYTCNPEIRRASHICPISKALNIHTH

SEQ ID NO: 874529 - protein, 105 aa, Homo sapiens
PTPDQGWGGLPGAHSAGTPPENTSAARPLPQSTTTPPGPLEDPLRFTTGPSSRWSDHRLVEWALGPPGDQGAGGGGQLIGRGAGAQCGARPTPRCPFPALASQAP

SEQ ID NO: 874530 - protein, 81 aa, Homo sapiens
ALTAALGASAEAPQGGQTPCLRAHSHWGGKGEGGMAAFCLHPPPQNPTVGSAAAASRAVPREARGVGLGTGDPFQPFPAPP

SEQ ID NO: 874531 - protein, 144 aa, Homo sapiens
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKASIDKMQ

SEQ ID NO: 874532 - protein, 140 aa, Homo sapiens
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 874533 - protein, 38 aa, Homo sapiens
PAKLKGIKQRFAAVLHALRQASSKASHLQSMISAAMFF

SEQ ID NO: 874534 - protein, 346 aa, Homo sapiens
QEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERN

SEQ ID NO: 874535 - protein, 346 aa, Homo sapiens; identical to SEQ ID NO: 874534

SEQ ID NO: 874536 - protein, 281 aa, Homo sapiens
QEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATKQTCSLADSILWVKAASSLRSSVEEDEGQERRKPWFLHPCECPRLFQIQCSQFYMMCNKPKRLY

SEQ ID NO: 874537 - protein, 356 aa, Homo sapiens
MWSWPGQKDMLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 874538 - protein, 356 aa, Homo sapiens; identical to SEQ ID NO: 874537

SEQ ID NO: 874539 - protein, 356 aa, Homo sapiens; identical to SEQ ID NO: 874537

SEQ ID NO: 874540 - protein, 282 aa, Homo sapiens
MELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 874541 - protein, 183 aa, Homo sapiens [sequence omitted]

SEQ ID NO: 874542 - protein, 410 aa, Homo sapiens
ARGTYTKIGTIQRRLAWPLRKDDTQIREAFHIFLDSPRSSAGTHTGAGIAPFRHVELAGARRHMLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 874543 - protein, 356 aa, Homo sapiens; identical to SEQ ID NO: 874537

SEQ ID NO: 874544 - protein, 393 aa, Homo sapiens
MWSWPGQKDMLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAGLHRPPGCSSRPPATRSLCGRSPASEMQQGLWWWASRLVMPGTWTQAWQRRQVVNGLMLGQARIHVNRLEQAVVNLAPCEYFHTCCPFA

SEQ ID NO: 874545 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 874546 - protein, 189 aa, Homo sapiens; identical to SEQ ID NO: 874545

SEQ ID NO: 874547 - protein, 189 aa, Homo sapiens; identical to SEQ ID NO: 874545

SEQ ID NO: 874548 - protein, 189 aa, Homo sapiens; identical to SEQ ID NO: 874545

SEQ ID NO: 874549 - protein, 189 aa, Homo sapiens; identical to SEQ ID NO: 874545

SEQ ID NO: 874550 - protein, 189 aa, Homo sapiens; identical to SEQ ID NO: 874545

SEQ ID NO: 874551 - protein, 125 aa, Homo sapiens [sequence omitted]

SEQ ID NO: 874552 - protein, 76 aa, Homo sapiens
LLCTPSIHTLNITKREKAIYFRIKLEVVWSLLNTQCCHAKRGSSPTWDATVKYSLGQVSRAQRPTFRVAQTGSKLF

SEQ ID NO: 874553 - protein, 306 aa, Homo sapiens
AGGRAGGRSWARGQARSSRSDCAPPPGRSGRLPMVRASCRLGSARTPSPARRPPGVRASQSRGGAAGTVSAWRRWCWRWPWRTAPSDGWRLPPGCLPGTDGVVPRPPAARSAAARPRETPGHTQLPPGARRRPRLESEMAFNDCFSLNYPGNPCPGDLIEVFRPGYQHWALYLGDGYVINIAPVDGIPASFTSAKSVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 874554 - protein, 94 aa, Homo sapiens
RTRSRGWHHVLLCTPAEPEIMGKTAHFCFVHFALGSESYSHYHHIPWHPIPHSTSEDYSGGIQGTLDILPMSLVILISVGPWVLTYETALLADY

SEQ ID NO: 874555 - protein, 66 aa, Homo sapiens
GTCKGPEARWSLAPGSNGLEGQRAVLTVWEVEVVLAGAAAVVAASVGQSRDLGDKIEGGGKERVRS

SEQ ID NO: 874556 - protein, 130 aa, Homo sapiens
GSASTRGCEEGRRVPRGTGSTCLRTDGGSLCSEKTQTPEGGCETERPVSVRLALFICLLPRRLQPLIPAHPVRKQTAASPTATRRGRLPRAGQAGQAAHLRRPTISWALYATLQKGSCEVLAIEAHLLVF

SEQ ID NO: 874557 - protein, 46 aa, Homo sapiens
IRQSETKGLVLEALCWWPWEEVSQSFSSAEISLDPVERKVSQRLCV

SEQ ID NO: 874558 - protein, 135 aa, Homo sapiens
SSPCHNYNQNPKGTDLPHCGCHKAQFLPSAAAVTSQVTVLPSKDVPEACACHTNMLICPKLPAELCPSPKVPLSNKSIYWSQTLDSVSDKCSPIIQRLTNVWISFLLFFFFKKHSMALFPRLECSGGIIAHCRNS

SEQ ID NO: 874559 - protein, 42 aa, Homo sapiens
MQGCRWALAHWVLGLWPVQEGKTIQVYGETASKPRWLPVEKQ

SEQ ID NO: 874560 - protein, 123 aa, Homo sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 874561 - protein, 171 aa, Homo sapiens
RNSASGIWLSSAMASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRGSKRRVILILSLELATKEMEVYMAGI

SEQ ID NO: 874562 - protein, 171 aa, Homo sapiens; identical to SEQ ID NO: 874561

SEQ ID NO: 874563 - protein, 190 aa, Homo sapiens
FPSTRSLITYIIIMDADLSHHPKFIPEFIRKQKEGNFDIVSGTRYKGNGGVYGWDLTHTNTIISDGVLPCCPGWSLLGSSDPAILASWDYRCEPPRLARSDCFIWQPVGPIFLTQILLRPGASDLTGSFRLYRKRSSREINTNTTVFLKATSSRWEMIVRARQLNYTIGEVFQYHLWIVFMVNPSWEEMK

SEQ ID NO: 874564 - protein, 171 aa, Homo sapiens; identical to SEQ ID NO: 874561

SEQ ID NO: 874565 - protein, 171 aa, Homo sapiens; identical to SEQ ID NO: 874561

SEQ ID NO: 874566 - protein, 171 aa, Homo sapiens; identical to SEQ ID NO: 874561

SEQ ID NO: 874567 - protein, 171 aa, Homo sapiens; identical to SEQ ID NO: 874561

SEQ ID NO: 874568 - protein, 171 aa, Homo sapiens; identical to SEQ ID NO: 874561

SEQ ID NO: 874569 - protein, 187 aa, Homo sapiens
RNSASGIWLSSAMASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHRKQKEGNFDIVSGTRYKGNGGVYGWDLTHTNTIISRGANFFNSDLAETRSI

SEQ ID NO: 874570 - protein, 171 aa, Homo sapiens; identical to SEQ ID NO: 874561

SEQ ID NO: 874571 - protein, 171 aa, Homo sapiens; identical to SEQ ID NO: 874561

SEQ ID NO: 874572 - protein, 171 aa, Homo sapiens; identical to SEQ ID NO: 874561

SEQ ID NO: 874573 - protein, 171 aa, Homo sapiens; identical to SEQ ID NO: 874561

SEQ ID NO: 874574 - protein, 100 aa, Homo sapiens
RNSASGIWLSSAMASLEVSRSPRRSRRELEVRSPRQNKYSVLLPTYNERENLPLIVWLLVKSFSESGINYEIIIIDDGSPDGTRDVAEQLEKIYGSDRIF

SEQ ID NO: 874575 - protein, 171 aa, Homo sapiens; identical to SEQ ID NO: 874561

SEQ ID NO: 874576 - protein, 80 aa, Homo sapiens
FPSTRSLITYIIIMDADLSHHPKFIPEFIRKQKEGNFDIVSGTRYKGNGGVYGWDLTHTNTIISRGANFFNSDLAETRSI

SEQ ID NO: 874577 - protein, 101 aa, Homo sapiens
DRVYGESKLGGNDIGTSPVGPIFLTQILLRPGASDLTGSFRLYRKRSSREINTNTTVFLKATSSRWEMIVRARQLNYTIGEVFQYHLWIVFMVNPSWEEMK

SEQ ID NO: 874578 - protein, 171 aa, Homo sapiens; identical to SEQ ID NO: 874561

SEQ ID NO: 874579 - protein, 171 aa, Homo sapiens; identical to SEQ ID NO: 874561

SEQ ID NO: 874580 - protein, 188 aa, Homo sapiens
RNSASGIWLSSAMASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFISDGVLPCCPGWSLLGSSDPAILASWDYSRGANFFNSDLAETRSI

SEQ ID NO: 874581 - protein, 142 aa, Homo sapiens
RNSASGIWLSSAMASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHVSGMFL

SEQ ID NO: 874582 - protein, 724 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874583 - protein, 664 aa, Homo sapiens
ISSSRKLGRREARDRETEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874584 - protein, 245 aa, Homo sapiens
MDEMSEQAESWMTSRGEGNLGEHLSSGCCHQPPSRCELLWRACHCFLAPRKGASPAVLGFRVVVEAWVVVQLGHLDYILCRGPGLASPELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874585 - protein, 177 aa, Homo sapiens
MDEMSEQAESWMTSRGEGNLELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874586 - protein, 746 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKAWSKSPMWRSIITALSRRAVGFAMSLPAMSGAVP

SEQ ID NO: 874587 - protein, 724 aa, Homo sapiens; identical to SEQ ID NO: 874582

SEQ ID NO: 874588 - protein, 732 aa, Homo sapiens
MPEVLLLRSASSILRTAFLSRWLPGGPRCVHKLSFVRNLQCRQGVRLNVRSSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874589 - protein, 505 aa, Homo sapiens
MQIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 874590 - protein, 755 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKAKHAASILAAWSKSPMWRSIITALSRRAVGFAMSLPAMSGAVP

SEQ ID NO: 874591 - protein, 43 aa, Homo sapiens
LRNSYAVFPVNLGMSHPKYTASPKPKWLPHRCQSWTTGFESRP

SEQ ID NO: 874592 - protein, 102 aa, Homo sapiens
SPMSSNAQEKKETSPPVKKWTLGMSDSPKQVTRTLRSMINTSDKSIYHLQPRDKSCQVDCLSTPFRDKDENCNHLSPSSCPLQVPSTTQQVFNKDVLSSFNT

SEQ ID NO: 874593 - protein, 76 aa, Homo sapiens
AVLPPSPSRATASEATWRPDLLDDGPLASPDRTVQGLRPTPHLDFSNWSWLPTGTKGPGMGKTWVPPAPPHLFAQR

SEQ ID NO: 874594 - protein, 438 aa, Homo sapiens
MVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 874595 - protein, 438 aa, Homo sapiens; identical to SEQ ID NO: 874594

SEQ ID NO: 874596 - protein, 358 aa, Homo sapiens
MPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 874597 - protein, 148 aa, Homo sapiens
CIQCDCPAVTGSRPGQTCSLPQSRGERCIHPQRGTRCSSGTPASSRPGAHCSFGTPASSSTAGALSPWPGRSPLSESPVHELCLFFGVLLSYSYEELLQSVDANPFPILFTVTTIWPVHSFYFPLVYGDFNNVALFQFANVFLYAFSY

SEQ ID NO: 874598 - protein, 98 aa, Homo sapiens
CIQCDCPAVTGSRPGQTCSLPQSRGERCIHPQRGTRCSSGTPASSRPGAHCSFGTPASSSTAGALSPWPATKEETTSSSSHSRRTPGNKDGMRIEKQS

SEQ ID NO: 874599 - protein, 48 aa, Homo sapiens
LIDIYRTLHPKSTRSLSNSSNISLYHYTATYLTGWHAGFLLQGHDIVI

SEQ ID NO: 874600 - protein, 69 aa, Homo sapiens
RMQGLGCKGLWMQSVLWMQKCLVILYVFHKMQVSLRVYHRLRDAIKHTLVVLVKQIKQVTPEMCTQEYV

SEQ ID NO: 874601 - protein, 109 aa, Homo sapiens
MAEDKVGAACLGPVAGTPEPEGADKDDLLLLSEIFNASSLEEGEFSKEWAAVFGDGKVKEPVPTMALGEPDPKAQTGSGFLPSQLLDQNMKDLQASLQGRKGGDRNWGT

SEQ ID NO: 874602 - protein, 46 aa, Homo sapiens
MVVLFDRARSFGRDAHGTVREEGDTRLASQISRINSGDQWGDRCHS

SEQ ID NO: 874603 - protein, 119 aa, Homo sapiens
MQLGKTILAILHRPYQTADSHPPITVPTTDPGHRPGCKPQLQKLVYGVKSQDSSYCGEEGREGVGEGHERGFRMVRFCFLIWVVVTGCVLFVILSRDVHLGFAIFSVKYFNKRHLFFKN

SEQ ID NO: 874604 - protein, 87 aa, Homo sapiens
AAARGARLQGAGACSGLEQAGGARLNGGRLSEGGKPFLPPPQAPEDRLADISSRYTDPPPHQETDVQTPRKEQANWGSFHPPRARGE

SEQ ID NO: 874605 - protein, 101 aa, Homo sapiens
LKPQAAENKWRRREGKKTKALVRTKPLISAKVGSIRFPFITWTKRHSHHPELRHSPTQFHVAGTKAASILKDVSDHSQGPLIIHIHSPGSPKGIRAEKALQ

SEQ ID NO: 874606 - protein, 125 aa, Homo sapiens
RQPIFSYDKDGIWLMSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTGKNAELSMKN

SEQ ID NO: 874607 - protein, 81 aa, Homo sapiens
LRDREGKTDVKMTFPMPGTGDLAPLSSRPPPSWQTGGLQGPAGPDSNSCSSSRQGPQLSQPGPRDLQHILRACCSLTERTR

SEQ ID NO: 874608 - protein, 74 aa, Homo sapiens
YKLIGGTCILEGKTQTASHLAAVCGTGQQEDKQLLLDLGLWEARKLGFALGTFLWKIGRTKSSLMSLKFSIIGK

SEQ ID NO: 874609 - protein, 45 aa, Homo sapiens
MGQHRKGCSLPLIWGAHDRPEGQTNSIGVCGLIFICTSTLVGMPG

SEQ ID NO: 874610 - protein, 247 aa, Homo sapiens
MAPPSRHCLLLISTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSALNHIVLKTLPALPTTFLTFLTLEPSQCQATKAMLSHLFTSIITVSSCLELWQMMNNLQKESGNKAVR

SEQ ID NO: 874611 - protein, 88 aa, Homo sapiens
SLSSRCDQLEERVSVMEDEMNEMKQEEKFREKRVKRNEQSLQEIWDYVKRPNLRLIGVPESDGENGTKLENTLQDLYQAREALSIRAT

SEQ ID NO: 874612 - protein, 82 aa, Homo sapiens
DRGVYPPGYRSTSSYDKIYNFFPLSGHGEQVRSPPRLLLVGEPYLLSPSVPPIWPQSLRDSGSPNYFSHRKLGSISVQVHLM

SEQ ID NO: 874613 - protein, 160 aa, Homo sapiens
MAAVCVMKDIKPEKISDPSGTGGKILDYWGPSKKLLGDMNFLRDLKEYDKDNIPVTVMQKIRSEYLMNPEFDPPKVAKASSAAEGLCKWIMAMEVYDRVAKVVAPKKARLSEAQKSLAETMELLNQKRAELAEVEHHLENLQMTFLEKTEEKAALEDQVE

SEQ ID NO: 874614 - protein, 109 aa, Homo sapiens
MPRRRVNLSHVLPAWAPCCRGVSATHSAGISGVPGTQTPTRSNRRLPGVHSPGRNPENKRQLPPEDMASSVRQTPSAFPTPLTIRPALLKRGAGLEQSQDTRTRCTQAS

SEQ ID NO: 874615 - protein, 98 aa, Homo sapiens
GRVGSDCCASNQRDSVGVGPSEPEMGSYYIAQAEVQWLLTAVIIMHCSFEFLGLSDLPTLASCVAETTGNKLKEKEETKMGRKCKRGILIYAFFITTV

SEQ ID NO: 874616 - protein, 115 aa, Homo sapiens
APRRFWHFLPLGSEAGPVVDSKEHRVSVLGTGLAPAGLATTQICSLVSSLTCAPQFPPIPLPVTEMIKCLVPCLVHPGSSSRCRSVASLLPPALCPHVHTCPCLAVSSLVGWVRL

SEQ ID NO: 874617 - protein, 139 aa, Homo sapiens
EEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPF

SEQ ID NO: 874618 - protein, 73 aa, Homo sapiens
PFASGNAGCFQGIPLSSDGYWSSLRHLLTSGLFHNVFRAQFSRGACQTLQACLLQWPSFGLSIEELLHPQGEL

SEQ ID NO: 874619 - protein, 35 aa, Homo sapiens
MSQQDDEFAQQDDEVAQQDDEKQDDEFAQQDDEFA

SEQ ID NO: 874620 - protein, 144 aa, Homo sapiens
PFLSLALCRSHVECRPCPWMRLRGSPYLIVSPLALLSLLGLVPAPLGNVLRPSNLEQNNFDSAPFPVQILVLACLWVSLGHCFCCQSASSSWPLAHVLPVCPLSWPLCESFPCPPGLRHPALPPTVCGSPLLAHLTVSPVWEPL

SEQ ID NO: 874621 - protein, 52 aa, Homo sapiens
CDLLSSSPKPGSSCDTLSSSPIPGSSCDLLSSSPNPGFSCDTLSLYPIPGSS

SEQ ID NO: 874622 - protein, 106 aa, Homo sapiens
GPFSGVLKHCCGVCLLCTREGMGRVAVCSTAHGQPFAYGVYCCGVPFLTIITPAVLPKLTHGPPAWHHHNCSSVCSLTFSSYWAEKPWRQRLSTHTPPPTSPLGFG

SEQ ID NO: 874623 - protein, 101 aa, Homo sapiens
PLSFFSWDPAWLSWFSGFSGESRGWKPEYGNLDSVSERCCGGSLSLIKLDLFLRERNSRGISRNHDQNRGKWWPHESATKQVTIVKTSAHCCLETGPRLSQ

SEQ ID NO: 874624 - protein, 106 aa, Homo sapiens
TLSQGKQKEKKTSTAGSGRYKSGKKETRQGEKLSYLPMEECGKGLTLVCMLDLSMEQGSPCGPIKCFSFIRLKSTKGKYNAHYFRNILSPAPPSGINSKYTLVDSM

SEQ ID NO: 874625 - protein, 120 aa, Homo sapiens
MALKLEHLLPRTGLQLHDLQTVTSATRPSNWNISSCQISSCMTLKLEHQLLLEYSATRPSNQNSSSPSLQLNDPQARTSAPPQVFSCKTLNLEHQLLPESSAARSSIQNISSSPGLQLQD

SEQ ID NO: 874626 - protein, 134 aa, Homo sapiens
LLNWQAGGWGLQLSLMWLHRGPLRPPGLRWTPWAFLEACSWGPALSLLGSGHSLPGTHEQAAWSRGCGQHGQSPTQKCKSSKEPLAQAPPWDSPAAPPHQGFADVLERPTLEPFGVLAPPVPAAHRSRCWKGSG

SEQ ID NO: 874627 - protein, 243 aa, Homo sapiens
LLNWQAGGWGLQLSLMWLHRGPLRPPGLRWTPWAFLEACSWGPALSLLGSGHSLPGTHEQAAWSRGCGQHGQSPTQKCKSSKEPLAQAPPWDSPAAPPHQGFADVLERPTLEPFGVLAPPVPSALVEVAATSPPQGAPRGILWDRCPQIQVLEGQRVRFPSQPQHPSHLAPRGGCGWRPDSRPLLPTPSGLSSFFPLDAQCWPWRTVSWRMAVGEAVFVPLQHPPLLHGSPIPKLLLSLAVKC

SEQ ID NO: 874628 - protein, 102 aa, Homo sapiens
KLELSLSGGRGIVLFLQTSLSVRSPLNSGIPGPCHLFTIFQNKTTIYLEAISNLITYNISGLALFPDSRLEHSATFLVIPAWKFTLNMPKLKCPVFPHRETC

SEQ ID NO: 874629 - protein, 95 aa, Homo sapiens
PQRERVRQGEETDRGKERERERQRQRQRKEQREKQKEREGEKDTKEKQKEKHTETKEETKTRKQEEKWREWEKMQNIRDSPGGRGPKFLGKAVLF

SEQ ID NO: 874630 - protein, 119 aa, Homo sapiens
AAEKGAVWVSLGSTLTAFALWPLKHKMQTTSLSAREMEQGLKNPEISDQVEASLTHWMTWGKSIHLSEPQAPVHVECDESWSVVSQGFSKLSASDIQGSCAHILEEIHIMNWFELPSAH

SEQ ID NO: 874631 - protein, 67 aa, Homo sapiens
AQLTSRFMLLHPVSRSMPSDTARTVMVLLFHIYDELQEWGRTEDLDLPCDSAKGANVVLLRPSTCQD

SEQ ID NO: 874632 - protein, 147 aa, Homo sapiens
ARGRALGSNDPMQSILNSLEQQHEEEKRSALGGQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVR

SEQ ID NO: 874633 - protein, 145 aa, Homo sapiens
MCFGKPLCPASAQKTQCHLLLLFLCHSRTFSRSEPPPASVRARPLSWQLIRRRAPDSFPAGPRARPGPMMEGGHQPRACPSRRDSPGPGGGDPWKSPLFPAPDSGSEILRSQAPVLQAEAGPPSGRSRDSCPWPSMRGRCVESPG

SEQ ID NO: 874634 - protein, 168 aa, Homo sapiens
HKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCTHCSKSFRQRAGLIMHQVTHFRGLI

SEQ ID NO: 874635 - protein, 57 aa, Homo sapiens
MAGGGPAVLSAPEQKSPLEGNLPAVSSILSPPLRDLGRAVWWHLKLESVSFFPTAPP

SEQ ID NO: 874636 - protein, 123 aa, Homo sapiens
TLGACMWQERGPAPLRLQHPSPLTVYLPCHATHKAVHRRQDIHQAATTASPHRPNTQQRAKPSRNTCMLTHARTHMHTHAHPHMHIHARSHTCTLTNMHTCAHTHAHTCTHALTQCSHACTHM

SEQ ID NO: 874637 - protein, 408 aa, Homo sapiens
MWAPRCRRFWSRWEQVAALLLLLLLLGVPPLLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQ

SEQ ID NO: 874638 - protein, 108 aa, Homo sapiens
WLSSNSVPTLSSRRCLPQLEGLVRKTAPCHTSHKPKPLELLINWLQVGVPMTPSLGSTNLLKQLTELRELTYVYRFIIKDIAEDTGEEMHRVKYGKTGMELPCPPRGH

SEQ ID NO: 874639 - protein, 481 aa, Homo sapiens
TQETPLKPVSQLPGPAGAPTGRRGQAEDPGSVMASALRPPRVPKPKGVLPSHYYESFLEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPVEKGFHHVAQAGLELLTSSDPPTSASQSAGITGVSHHTWPHLSSLPEPKVFNGGLGRKLPVSSAQPLFPTAGLADMTAELQKKLEKRRALEH

SEQ ID NO: 874640 - protein, 354 aa, Homo sapiens
TQETPLKPVSQLPGPAGAPTGRRGQAEDPGSVMASALRPPRVPKPKGVLPSHYYESFLEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPEPKVFNGGLGRKLPVSSAQPLFPTAGLADMTAELQKKLEKRRALEH

SEQ ID NO: 874641 - protein, 390 aa, Homo sapiens
TQETPLKPVSQLPGPAGAPTGRRGQAEDPGSVMASALRPPRVPKPKGVLPSHYYESFLEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLFPTAGLADMTAELQKKLEKRRALEH

SEQ ID NO: 874642 - protein, 435 aa, Homo sapiens
TQETPLKPVSQLPGPAGAPTGRRGQAEDPGSVMASALRPPRVPKPKGVLPSHYYESFLEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLFPTAGLADMTAELQKKLEKRRALEH

SEQ ID NO: 874643 - protein, 435 aa, Homo sapiens; identical to SEQ ID NO: 874642

SEQ ID NO: 874644 - protein, 410 aa, Homo sapiens
TQETPLKPVSQLPGPAGAPTGRRGQAEDPGSVMASALRPPRVPKPKGVLPSHYYESFLEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPGLADMTAELQKKLEKRRALEH

SEQ ID NO: 874645 - protein, 242 aa, Homo sapiens
MSSYFVNPLFSKYKAGESLEPAYYDCRFPQSVGRSHALVYGPGGSAPGFQHASHHVQDFFHHGTSGISNSGYQQNPCSLSCHGDASKFYGYEALPRQSLYGAQQEASVVQYPDCKSSANTNSSEGQGHLNQNSSPSLMFPWMRPHAPGRRSGRQTYSRYQTLELEKEFLFNPYLTRKRRIEVSHALGLTERQVKIWFQNRRMKWKKENNKDKLPGARDEEKVEEEGNEEEEKEEEEKEENKD

SEQ ID NO: 874646 - protein, 92 aa, Homo sapiens
TGCQVGMNDDIRDSDLPDWRDRTPWCLEISWTTVSSQSCSPLLTSPRLENCQPAIFDGRLLEEMDNEKRIRLLAVCHWYLTCACRGMCGTHR

SEQ ID NO: 874647 - protein, 68 aa, Homo sapiens
RSPMSWVQVGPRNTPMVGSAFAGSHPAAVLTGVEAEGQALTVDTHALCDQQVDWPADCLTQMTDRQTD

SEQ ID NO: 874648 - protein, 108 aa, Homo sapiens
IECSGTISAHCNLRLLGSSNSPASASQIAGITGASHHAQLIFVFLVETVFHHVSQAGLKVLTSSDPPALASQSAGNTGKSHTVPSLRALSSDLSFPLLLKLLYPEAEA

SEQ ID NO: 874649 - protein, 219 aa, Homo sapiens
FEADIDATTTETYMGEWKNDKRSGFGVSERSSGLRYEGEWLDNLRHGYGCTTLPDGHREEGKYRHNVLVKDTKRRMLQLKSNKVRQKVEHSVEGAQRAAAIARQKAEIAASRTSHAKAKAEAAEQAALAANQESNIARTLARELAPDFYQPGPEYQKRRLLQEILENSESLLEPPDRGAGAAGLPQPPRESPQLHERETPRPEGGSPSPAGTPPQPKRP

SEQ ID NO: 874650 - protein, 79 aa, Homo sapiens
DHTDVLGLQRASTDVRALCACCLYTRLVSWTLKTGQGVVCVIRSAEHSLLKMWFECFLQGHMCLIPDRQEPPGGCLLFV

SEQ ID NO: 874651 - protein, 118 aa, Homo sapiens
MVKRHSLSSGRVSRSASLSSYPLSRSLWIISFTDPVLERRGIALSRTVRECQELLDLRLRGWVFLYLMCTKFPASSCQEFKGVRIIDHIAIIEAAPDTVLRASYALPQRSCSRGTPVV

SEQ ID NO: 874652 - protein, 118 aa, Homo sapiens; identical to SEQ ID NO: 874651

SEQ ID NO: 874653 - protein, 88 aa, Homo sapiens
SCRPQIHGPPTTCILSGEESQALSTSRGPEGSRGHKPCKATGAKLPKALGAQPSHPCALDVGQGFKKGDFGAVGLNDWPFGFGVSWDR

SEQ ID NO: 874654 - protein, 154 aa, Homo sapiens
MTHCCSPCCQPTCCRTTCCRTTCWKPTTVTTCSSTPCCQPSCCVSSCCQPCCRPTCCQNTCCQPTCVTSCCQPSCCSTPCCQPTCCGSSCDQSSSCAPVYCRRTCYYPTTVCLPGCLNQSCGSNCCQPCCRPACCETTCFQPTCVYSCCQPFCC

SEQ ID NO: 874655 - protein, 78 aa, Homo sapiens
PVVEPRRGPWLGVAFQISRLLFPTDSVVWTLPRESGAPEGGGAGLPGASVALHPRASTSVAAVGGCMLCQADGWPRGT

SEQ ID NO: 874656 - protein, 85 aa, Homo sapiens
QSPNSAQSPNSAQSPNSAQSPNSAQSPNSAQSPNSAQSPNSAQSPNTALSLRNQSFSELMISPLHSSLGDRVPGVLSGCSPRMPG

SEQ ID NO: 874657 - protein, 54 aa, Homo sapiens
DTAKPYHWVSKRAAKCNSQSLHFKDKVIKTCAFGTSFLPLVHDTQLVFCSFYSF

SEQ ID NO: 874658 - protein, 103 aa, Homo sapiens
PSLPGSTNSPHLSFPSSWDHRCPPPSLANFKNFLEMESCHVAQDGLELLGSSNPPASTSQSARIIGVSHCTQLQVAFLILPVIREGGRWIEPETSFSFSAGAE

SEQ ID NO: 874659 - protein, 823 aa, Homo sapiens
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIHCSSPDTTEPGYINIMELAASVCRYDLDDMDIFWLQELNEDLAEMGCGPVDENLMEKTVEVLERHCHENMNHAIETEEGLGIEYDEDVICDVCRSPDSEEGNDMVFCDKCNVCVHQACYGILKVPEGSWLCRSCVLGIYPQCVLCPKKGGALKTTKTGTKWAHVSCALWIPEVSIACPERMEPITKISHIPPSRWALVCNLCKLKTGACIQCSIKSCITAFHVTCAFEHGLEMKTILDEGDEVKFKSYCLKHSQNRQKLGEAEYPHHRAKEQSQAKSEKTSLRAQKLRELEEEFYSLVRVEDVAAELGMPTLAVDFIYNYWKLKRKSNFNKPLFPPKEDEENGLVQPKEESIHTRMRMFMHLRQDLERVRNLCYMISRREKLKLSHNKIQEQIFGLQVQLLNQEIDAGLPLTNALENSLFYPPPRITLKLKMPKSTPEDHRNSSTETDQQPHSPDSSSSVHSIRNMQVPQESLEMRTKSYPRYPLESKNNRLLASLSHSRSEAKESSPAWRTPSSECYHGQSLGKPLVLQAALHGQSSIGNGKSQPNSKFAKSNGLEGSWSGNVTQKDSSSEMFCDQEPVFSPHLVSQGSFRKSTVEHFSRSFKETTNRWVKNTEDLQCYVKPTKNMSPKEQFWGRQVLRRSAGRAPYQENDGYCPDLELSDSEAESDGNKEKVRVRKDSSDRENPPHDSRRDCHGKSKTHPLSHSSMQR

SEQ ID NO: 874660 - protein, 107 aa, Homo sapiens
EAGTGKGPQAPEAGLGRLQSPVIHGSSSLSLHRPVRSFLGRQDTLQREPSDELVRPLVGTSIAWVSAEPLALSPVSRGGSPLGPSIPTAAGAGAFPALQVDIACFLT

SEQ ID NO: 874661 - protein, 70 aa, Homo sapiens
MQGWLSSTAGRAPRKDSAAAVSKPAAGGTQRDPLLDIPAGQRSLGDETGDGAAVPAAPSGDITGVLPDLT

SEQ ID NO: 874662 - protein, 74 aa, Homo sapiens
EIFYSLGFLDSNCPWFLCYLPDYSSVSIIDSVPQSALLNVAVRCSVRGLCCSLNVSPPKSKYWKLNPQCNSVET

SEQ ID NO: 874663 - protein, 39 aa, Homo sapiens
MCSVKLLLCAPRGLRILTLFVSPRTLRVCTGPFSERCPD

SEQ ID NO: 874664 - protein, 116 aa, Homo sapiens
RSDERMPVKDWARFWHIVVKAPQEAGGGAGLTPTQGSIFPPIIFFLVLILHCCHRWGLRSRTCLQKPHSLCPLPGLYPSLPQTAWSWCIWTVAAGTCVRAVSQVIFFFKNNVCLFF

SEQ ID NO: 874665 - protein, 117 aa, Homo sapiens
SEFGNKKYGSNKVGVGVVATGATGRSAQWEEFCLLSKGEEGRPLPQWHPMALTSLSDACWYTKLDVAEWDVRWEALRGSPGGHVAAIRAFWWQHQGHISNRPRGGHCTSHWTVRENT

SEQ ID NO: 874666 - protein, 86 aa, Homo sapiens
ASLGCGSTWSCSHLAAARPPGSRASTLHPSPSLPPAFAPAPPEHSPSWQPCAQMHVQQPLPAHRDTGPMPVHVEQPVNYRANKQAS

SEQ ID NO: 874667 - protein, 122 aa, Homo sapiens
MPLLSSMRGCIWEMQVDTHSRFLKWDTVVELILCFSPCHRAPTLTCGFLGELRMDTLLGCELCMMAIVRSGWAQPEPMELAKRKDRTEFLGSPTAAVYHRVPLSSPLLGLNQTDQVHLGQSS

SEQ ID NO: 874668 - protein, 69 aa, Homo sapiens
PALPPPVPENALSQCYIPTHNRTHTRHVPFLHLSWRMHIPSAEMLPSLFCYICSFRKVLDLCEGWFGEE

SEQ ID NO: 874669 - protein, 261 aa, Homo sapiens
SDCSLRHSRGFHSWTRPPPLGLASKPPQLSALEGAQRRETSPFRTTPPLQVASSDRKAGGGETQRNRGRRDRRGARCSGEREAQTRQPRTESHPALIVTKQREAREHVAGTERTSGNEKRTDGRENNARTDGDGRRAQAAQPTRRTSLQRHRTVLTSLLRQSDEESIGSGLTSEELRPAPRNDETPAHAKTRAEASVPPERGQDQGSKRYTQHLIHIKPQKYQFTMNHYYMKITDPVLERPKIGHHITLASEYTKLFTSTS

SEQ ID NO: 874670 - protein, 155 aa, Homo sapiens
MDFSTPSVFDQQRGDSSEEVDLTMVYQAASNGDVNALTAVIREDPSILECCDSEGCTPLMHAVSGRQADTVKLLLKMGANINMQDAYGRTSLCLATYLGWLEGCVSLLRNGAKHNIPDKNGRLPLHAATAEPDMRLLTVLLQQSNISEINHQDNE

SEQ ID NO: 874671 - protein, 40 aa, Homo sapiens
MPPSPHSFRTLAKSPRAAAAQGLTRTASHWPLPSQKSVPG

SEQ ID NO: 874672 - protein, 321 aa, Homo sapiens
RECVYFLPFFIRAPKISRNGQWLFTFTTPFPFANKALPGWEGIVPACFWRKKILTPSTGTMELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 874673 - protein, 321 aa, Homo sapiens; identical to SEQ ID NO: 874672

SEQ ID NO: 874674 - protein, 321 aa, Homo sapiens; identical to SEQ ID NO: 874672

SEQ ID NO: 874675 - protein, 321 aa, Homo sapiens; identical to SEQ ID NO: 874672

SEQ ID NO: 874676 - protein, 321 aa, Homo sapiens; identical to SEQ ID NO: 874672

SEQ ID NO: 874677 - protein, 190 aa, Homo sapiens
MSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 874678 - protein, 238 aa, Homo sapiens
RECVYFLPFFIRAPKISRNGQWLFTFTTPFPFANKALPGWEGIVPACFWRKKILTPSTGTMELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGTPENGNDQPQSDKESVKLLTVKTISHESGEHSAQGKTKN

SEQ ID NO: 874679 - protein, 201 aa, Homo sapiens
RECVYFLPFFIRAPKISRNGQWLFTFTTPFPFANKALPGWEGIVPACFWRKKILTPSTGTMELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKKVVFYNQMHHLLKLVH

SEQ ID NO: 874680 - protein, 73 aa, Homo sapiens
MANVLMTLMTEEKTQTQRRNQCEDQAEIRMTWLQTEDAVDHQKLEEANNGFSLDLLAGVLWPCPHVHLRLMAS

SEQ ID NO: 874681 - protein, 107 aa, Homo sapiens
MVGGQLQAFWKHGVQVWALGSDQHAYEEHERPLPLYITSRAVDRPKVRELILMLRASQVAWVYGACSGGDTALVEVILRVSQLDLLHPGMSPWGVSGRLVLGPRLPP

SEQ ID NO: 874682 - protein, 120 aa, Homo sapiens
SGSSSLCLRCNSQDGFVGAWGFPFSLMGHGHRGEDSGPEDNTFPNPGIGTFLGQGCQCPRGDMGTEKQGERREPLGADPAPPLIFPTASPGGSSCFPLGGEERDVRKSSSRLHPRAPTLI

SEQ ID NO: 874683 - protein, 273 aa, Homo sapiens
MNWSIFEGLLSGVNKYSTAFGRIWLSLVFIFRVLVYLVTAERVWSDDHKDFDCNTRQPGCSNVCFDEFFPVSHVRLWALQLILVTCPSLLVVMHVAYREVQEKRHREAHGENSGRLYLNPGKKRGGLWWTYVCSLVFKASVDIAFLYVFHSFYPKYILPPVVKCHADPCPNIVDCFISKPSEKNIFTLFMVATAAICILLNLVELIYLVSKRCHECLAARKAQAMCTGHHPHGTTSSCKQDDLLSGDLIFLGSDSHPPLLPDRPRDHVKKTIL

SEQ ID NO: 874684 - protein, 273 aa, Homo sapiens; identical to SEQ ID NO: 874683

SEQ ID NO: 874685 - protein, 273 aa, Homo sapiens; identical to SEQ ID NO: 874683

SEQ ID NO: 874686 - protein, 155 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 874687 - protein, 155 aa, Homo sapiens; identical to SEQ ID NO: 874686

SEQ ID NO: 874688 - protein, 155 aa, Homo sapiens; identical to SEQ ID NO: 874686

SEQ ID NO: 874689 - protein, 155 aa, Homo sapiens; identical to SEQ ID NO: 874686

SEQ ID NO: 874690 - protein, 155 aa, Homo sapiens; identical to SEQ ID NO: 874686

SEQ ID NO: 874691 - protein, 127 aa, Homo sapiens
AVVSTQSAHYGRGKLLQPRCCAVGKGEGFVNPGARFCLPEAAAVRRPPGEATVIMSDQESLNPESLVRRHGEKWSQAHTMMADKGREADNLFFLRRSLALSPSLECSGAISTRCNLRLPGSRGKTFN

SEQ ID NO: 874692 - protein, 130 aa, Homo sapiens
AVVSTQSAHYGRGKLLQPRCCAVGKGEGFVNPGARFCLPEAAAVRRPPGEATVIMSDQDSSEIHFKVKMTTHLKKLKESYCQRQGVPMNSLRFLFEGQRIADNHTPKELGMEEEDVIEVYQEQTGGHSTV

SEQ ID NO: 874693 - protein, 155 aa, Homo sapiens; identical to SEQ ID NO: 874686

SEQ ID NO: 874694 - protein, 183 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKVKMTTHLKKLKESYCQRQGVPMNSLRFLFEGQRIADNHTPKEGGSFNSLDILFIFFLFPQSFFIFKNSSFVTVVFKTGIENWHPISLKHLVI

SEQ ID NO: 874695 - protein, 131 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKVKMTTHLKKLKESYCQRQLGMEEEDVIEVYQEQTGGHSTV

SEQ ID NO: 874696 - protein, 143 aa, Homo sapiens
SSGINAECPLRPGGEGFVNPGARFCLPEAAAVRRPPGEATVIMSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 874697 - protein, 155 aa, Homo sapiens; identical to SEQ ID NO: 874686

SEQ ID NO: 874698 - protein, 212 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKVKMTTHLKKLKESYCQRQFTGQRQAGWFPQSFGKKFFSQKIFSPKKGGGIFNVSNKKSFHTNYFKVKNCGGGKKKEGGEEERGGFFPQKKRGGKKRGGAQIRKYFFEKRGGGKKYILGGEK

SEQ ID NO: 874699 - protein, 155 aa, Homo sapiens; identical to SEQ ID NO: 874686

SEQ ID NO: 874700 - protein, 155 aa, Homo sapiens; identical to SEQ ID NO: 874686

SEQ ID NO: 874701 - protein, 143 aa, Homo sapiens; identical to SEQ ID NO: 874696

SEQ ID NO: 874702 - protein, 155 aa, Homo sapiens; identical to SEQ ID NO: 874686

SEQ ID NO: 874703 - protein, 155 aa, Homo sapiens; identical to SEQ ID NO: 874686

SEQ ID NO: 874704 - protein, 112 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKVKMTTHLKKLKESYCQRQVSL

SEQ ID NO: 874705 - protein, 155 aa, Homo sapiens; identical to SEQ ID NO: 874686

SEQ ID NO: 874706 - protein, 155 aa, Homo sapiens; identical to SEQ ID NO: 874686

SEQ ID NO: 874707 - protein, 155 aa, Homo sapiens; identical to SEQ ID NO: 874686

SEQ ID NO: 874708 - protein, 176 aa, Homo sapiens
AVVSTQSAHYGRGKLLQPRCCAVGKGEGFVNPGARFCLPEAAAVRRPPGEATVIMSDQEAKPSTEDLGDKKEGEYIKLKVIGQDSSEIHFKGVPMNSLRFLFEGQRIADNHTPKETGDLGWGADLTSVGLEPRPGVYSTGNPTFLLTGFIGNRFVFFLVAPRETVFKAAFLTFSGT

SEQ ID NO: 874709 - protein, 146 aa, Homo sapiens
DEIHGKNVGLEGGHECKFWICSLLLCDLGQLTFFEPWFLLRMGVTPSMIVVKIKYNEDVTAWSLINCHNMLRHIVSTYVTYVETICETESHSAPQAGVQWCDLGSLQPLPPGFKPFFCLSLPSSWDYRHLPPHPDNFCIFSRDGIS

SEQ ID NO: 874710 - protein, 108 aa, Homo sapiens
PPASLWVSATSFQAGSKQLPLTPKLCFQSHLEIGINRPGFWILGKGSWWPSLDSCPSLDQDLGHFGCLPIPNLRWSGTGLVEDVSFPSNHNVRVSEGAFLEKRGRDIW

SEQ ID NO: 874711 - protein, 76 aa, Homo sapiens
AAAYYYYYCSEFKLLTMYGVMPDLMKTPLKNQPSSSPKPISKLLYLHKQYLEPWIPKIHIIASGEWLFCPLCWNNK

SEQ ID NO: 874712 - protein, 33 aa, Homo sapiens
NSEESPVLPRSPSETELYCLWQWPHLSALILAF

SEQ ID NO: 874713 - protein, 52 aa, Homo sapiens
MREKGSVPRPLFGLQVAVLSLSLHIVFPLYLSVATVVLLIRIRSHWIQPTLM

SEQ ID NO: 874714 - protein, 34 aa, Homo sapiens
MCLFPLLACEPPENRDGDLSTEATTVSPAPAQHP

SEQ ID NO: 874715 - protein, 75 aa, Homo sapiens
QCKLSMRPWGADPEAPAELHVVDKGLYCSMPGTLSSGPRQRGPQRSNSRGHSGAPGTRPVPFTVFLTGALTPAAG

SEQ ID NO: 874716 - protein, 115 aa, Homo sapiens
MHTCTCAQLTNKHICTHMQYTHMQTGRCTGMGTHAQGMHVQVCRHTHLHAHTRTCTCTHTSAHRHQRHTCSCTRIHTDMHTYACTRHDRMAREQPCTWSLFCVYREPAPLTVCMT

SEQ ID NO: 874717 - protein, 166 aa, Homo sapiens
YWPSSVSRGFCPEAVCSLSVLEVLLLVSGWPAQSLTLRRAQSYFQSLLCSFSLCKFPGVETAPARQGTAFYCFENESQLWAFRLGIWCGSSGRPIAGPLGELCVGSAPGPAAPGSKHSPKTMLPCTVLGQPSKRWLAEGAQCVTNMCKTVPYLWWKQRALKGPRGQ

SEQ ID NO: 874718 - protein, 153 aa, Homo sapiens
TLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDII

SEQ ID NO: 874719 - protein, 46 aa, Homo sapiens
PIWSASPPRAPRSSTPCPGGAVREDTYPVGTQGVPSPALAQGGPQG

SEQ ID NO: 874720 - protein, 206 aa, Homo sapiens
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINREKLRPRDWPQKPQGHGKRRSIMATRPFVQWKFPLVGSSQGEKQSRPST

SEQ ID NO: 874721 - protein, 107 aa, Homo sapiens
MAANYSSTSTRREHVKVKTSSQPGFLERLSETSGGMFVGLMAFLLSFYLIFTNEGRALKTATSLAEGRNSEIEEAMEPVSHAFVSFPKKNVFSCTGSHCLHFTLPQL

SEQ ID NO: 874722 - protein, 147 aa, Homo sapiens
MFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINRKNFDREIGHKNPSAMAVESFMATA

SEQ ID NO: 874723 - protein, 35 aa, Homo sapiens
FHPLSDGDGVSAPLSDGERVSTPLSGGERVSTPLS

SEQ ID NO: 874724 - protein, 135 aa, Homo sapiens
LSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSRWNGCEGRGQASHQVARSSKHSRFEFV

SEQ ID NO: 874725 - protein, 149 aa, Homo sapiens
LSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSRRSLALSPRLECDGAILDGAISAHCNLGLPVSAVLLPQPPE

SEQ ID NO: 874726 - protein, 71 aa, Homo sapiens
LLPDMAAGFPQNKMEATVSLMTYPRKVFLIFATFYLLETNHKVQLHSRQELRSTSRREEYQTIVDMQSCTT

SEQ ID NO: 874727 - protein, 105 aa, Homo sapiens
PRELIGEALPQGSYSSPEQSLICRSVCRHMLGQPGTQPRVWLKFLPSAWDVGVGRRVHSLHILFRHQSRQELDFPGSSPSSHFLICVALSEVLLSEPVSASVKRE

SEQ ID NO: 874728 - protein, 126 aa, Homo sapiens
GAQTCREGEGCGPQVGPWGLPQFVMGARSGGFQEALSNMGVSWRYSASGAGLRGCGQTLWVDTSPSLLDLSHQVLKSRSSIISLLTKFRRLIVYWGKKIKLCRRLTLWLCRGALQGQDPCPPLGHV

SEQ ID NO: 874729 - protein, 69 aa, Homo sapiens
PAGLALSWQLLLGGTKRIHHNTPRAVPWSQPERGNGGNLLFILLISAPVCLLRASMSRPWVQSLKGNSD

SEQ ID NO: 874730 - protein, 73 aa, Homo sapiens
SDYCIKQCKFKKILLEGKEYSIPLILLSLTGFFYSFDFYWAAWFNIKFLFLQLPENTAPLLNSVLLCGRLMLI

SEQ ID NO: 874731 - protein, 229 aa, Homo sapiens
MRQGRSQPTPPGHKKTSTHPESTTESQTKKRHAHENNSTTAALTTHSGQQKKQRAREIPESKHHTGDATQRTHSKHHTQHTHSPAAETITDPRTHSGSHNNEQQQPAQHHARPASDPATNQRVGPAHHHRASAGWREGGGRGEAHGCHERRSREDVETRDGEDHERAPRSHAKQTPGNTTGHASSPRDPQGRRRATTQRDETYTNRTRGERGQQVQLSRAGQTRRVLKQ

SEQ ID NO: 874732 - protein, 139 aa, Homo sapiens
MKLKQKEMQKINETNSWFFEKINKIDRPLARLTKKRRGKIQISSIRNEMGDITTDTTEIQKIIQGYYEHIYVHKLENMEDMDKFLERDNPPSLNQKELETLNRPLTSSEIEMVIKKLPARKSPGPDGFKLNSARHSKKN

SEQ ID NO: 874733 - protein, 102 aa, Homo sapiens
RRPASCLTNKSSFPFKCRPLNTVKGRGGSCFLRRASGSPASLFQWKRGLSVLRNRESADASAMTNFFAAFIAPCKSFCDLSLPFGFTLLTGLGACPQKASSY

SEQ ID NO: 874734 - protein, 120 aa, Homo sapiens
GRTDQDEHDGTRRPLPPPGPSSPDTASKTADGCPCPKSEDPGVVSSLPTPTACAYSVETCGQARGLPGRAWLRSGTREPGQGPASASPAPRYPGTLRTQAPPSPEPSQRDRPTPRTPRGT

SEQ ID NO: 874735 - protein, 456 aa, Homo sapiens
MSHNTQTNIIFHSPGNEMKTKAPPVGEVTVTAADIMAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 874736 - protein, 456 aa, Homo sapiens; identical to SEQ ID NO: 874735

SEQ ID NO: 874737 - protein, 73 aa, Homo sapiens
MCRIDQKTKRGFAEIMLSARYLAPKPQEMEAQRASLVASRKGQSFKQGPSNGQLPWPAPGCLQKAWRKAFAKV

SEQ ID NO: 874738 - protein, 111 aa, Homo sapiens
NHPPSLYCCSVCFGQGVGERPCAVGLVACSGTAMGTWQLKTDGSRTKETFALEAQPNSPGHRHRWHLEHGLPQSGGRACVVQRAQPGTKKEMRPLSSMSPCPDTYLGRNFF

SEQ ID NO: 874739 - protein, 30 aa, Homo sapiens
MAAEQKKLLLWKHTHTHTHTLTAENLVPGS

SEQ ID NO: 874740 - protein, 145 aa, Homo sapiens
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 874741 - protein, 265 aa, Homo sapiens
RVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPNKMLTACTALPKSRNSRDPPVDSSWRHMGHLHKANVTTDNGP

SEQ ID NO: 874742 - protein, 110 aa, Homo sapiens
MGPGNLNMNMNVNMNMNMNLNVQMTPQQQMLMSQKMRGPGDLMGPQGLSPEEMARVRAQNSSGVMGGPNKMRLPAQPFPSSRNSRDPPVDSSWRHMGHLHKANVTTDNGP

SEQ ID NO: 874743 - protein, 119 aa, Homo sapiens
TTVQPQLPLCRGHASSPTWPHASLQQPYNVWLIVLITDGHLPKPTSSGSDTAGVQTEPFCPNPMLSTHLCTATPLLPPSALSLIKCFKMKAESTVGLRKHQFSTVKKVSFRKINLNKIL

SEQ ID NO: 874744 - protein, 44 aa, Homo sapiens
MSAHTSHTPCTSHRPLHAQLLHACLTHTLHTCLLHTHLTYRPCT

SEQ ID NO: 874745 - protein, 128 aa, Homo sapiens
RGRRQDGDESVFRLRAGRRPAVQHPPGGRDFGLVIPRCCDSAHDSSWSPLAPRKYLSNDSMNLPPDRPGLLSLSVSPEVETTPPALASGLPCALPWTVGCSGSDAVTALCPSLRGLACICSILWDPAW

SEQ ID NO: 874746 - protein, 75 aa, Homo sapiens
GEDAKMATSQYFDFAQGGGPQYSPEVETTPPALASGLPCALPWTVGCSGSDAVTALCPSLRGLACICSILWDPAW

SEQ ID NO: 874747 - protein, 188 aa, Homo sapiens
CPGDTQFSATSTTVGWCYTLNTLARLFCPSAPRNLARGVVLPTYLSPPPPSGGVFPHKDSSSMQVVSPTNNSVYIHALRLLPFKNNASLLLGPPCAQKKGGPRKMGPPRESIFRAPPPFFFFFFFFVFFFFFFFFCVFLFLHPPLYPCPSHHVLATLPVQKWRPLPRPLHLGFLVPCLGQLAAVEVTL

SEQ ID NO: 874748 - protein, 77 aa, Homo sapiens
MALPMGGHRHLTAVCCSPGVSPGKEVRRQLQPATESVPQEEEVAGSEVPECTALNPGPLALPLAPGTGALMPWPRSF

SEQ ID NO: 874749 - protein, 108 aa, Homo sapiens
NTSSTFSLVSAWFPGEGCLGGAVQFQDAKLKDGDESLNLGNVEKSGEEKLEVLPCIPPPIHVREVPLCLLFFLGLSTTMKNPLGKGIRSLRRSTDLSMSRALQTVISY

SEQ ID NO: 874750 - protein, 107 aa, Homo sapiens [sequence omitted]

SEQ ID NO: 874751 - protein, 45 aa, Homo sapiens
MCGGEALGISARERGHWLEKGLWERWGREPGVDGRRLDGHGVCGR

SEQ ID NO: 874752 - protein, 103 aa, Homo sapiens
MTNVSSNNRTISPLTTRPPFSLISPTLGSHAAPNPARSSPEKHRPFSLSTPPPKNFRCPNTSTLFCFIFLINIRRQECQASEPKLSHRIPCDLHAYISPDGLK

SEQ ID NO: 874753 - protein, 196 aa, Homo sapiens
APALRGHREPAGGRLPRLVGGSGPRTVPGAAIDARGEASRIKILEQNSELPQRVCGWNGLRTLCIAKRVLSKEEYACWLQSHLEAESSLENSEELLFLVCRFAWRPSCHLLGATGIEDRLQDGVPETISKLLSSGPADLGLTGDKQETAVNIAYACKLLDHDEEVITLNASLPGGVCSPARPVPMLRAVQRPPESP

SEQ ID NO: 874754 - protein, 182 aa, Homo sapiens
IHTGEKPYECRECEKAFCCSSHLTPHQRIHTMEKQYECNKCLKVFSSLSFLVQHQSIHTEEKPFECQKCRKSFNQLESLNMHLRNHIRLKCDFYLMNAIYVGKPLVIGHPCFNITEFILERNLTNVLNVGRPSAVVQTLPYIREFILEKSHINVVSVGKLLAKAQILLPIKEYIMERNPIVW

SEQ ID NO: 874755 - protein, 451 aa, Homo sapiens
LCLVRPACLHSCLHHVHQGTQKSYKVSTSGPRAFSSHSYTSGPGAHISSSSFSQVGSSCFRGGLGGGCGGASGMGGITAVTVNQSLLSPLVLEVDPDIQAVCTQEKEQIKTLNNKFASFIDKVRFLEQQNKMLETKWSLLQQQKTAGSNMDNMFKSYINNLRRQLETLGQEKLKLEAELGNMQGLVEDFKNKYEDEINKRTEMENEFVLIKKDVDEAYMNKVELESRLEGLTDEINFLRQLYEEEIRELQSWISDTSVVLSMDNSRSLDMNSVIAEVKAQYEEIANRSQAEAESMYQIKDEELQSLAGKHGDNLRCTKTKISEMNRNISRLQAENEGLKGQRAFLEAAIADAEQCGELAIKDANAKLSELEAALQRAKQDMAWQLREYQELMNVRLALDIEIATYKKLLEGEESRLESGMQNMSIHTKTTSGYASGLSSACGGLTSPGLSY

SEQ ID NO: 874756 - protein, 320 aa, Homo sapiens
RGGRVAAAALRSRWARGDAAAAGSREGRGRMNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLT

SEQ ID NO: 874757 - protein, 42 aa, Homo sapiens
LTISLSVRHSTPHGHSIIPFCMCKCRRPAHTSLRVSWQGHPA

SEQ ID NO: 874758 - protein, 60 aa, Homo sapiens [sequence omitted]

SEQ ID NO: 874759 - protein, 74 aa, Homo sapiens
SGGTQEAAVQGGLCIFWVSSLPPCGWGFRQQPSGLLLWSAGAASRAISPPYLRVLHWPPGRPLLAKAHTAVWGS

SEQ ID NO: 874760 - protein, 107 aa, Homo sapiens
SLCHLDLECSGAISAYCNLCLLGSNDSPISAFQVAGTIGACHHTQLIFVFLVEMGFCPVGQAGLALLTSGDMPASASQSVGITGQRSWPGILFTPHPSKDRQRLLLI

SEQ ID NO: 874761 - protein, 67 aa, Homo sapiens
TDQYEPKDIIYLICTKFMTVIFFTIFEPGLAVSPKVERRGVIRIHCNYKLLDSKQSSHLSLPRQLGL

SEQ ID NO: 874762 - protein, 75 aa, Homo sapiens
SSSAIPHVNVFYVWPKTILLPVWPREAKRLDTPGPGHVALLHSPFTRHLQDSCKTAAHCSLGVISTAHSTVQHTA

SEQ ID NO: 874763 - protein, 111 aa, Homo sapiens
GIWDCHCVVAQVASNSRNYFNLKHRSGCGNQLEKDFSSPKTKAGGCGSRCRGEDGKHQLSIALVVENREMVKKRAPLKGWDPKDGGGVERKTLLHKENLSLGCVHCTWVPY

SEQ ID NO: 874764 - protein, 75 aa, Homo sapiens
MTKKRRNNGRAKKGRGHVQPIRCTNCARCMPKDKAIKKFVIRNIVEAAAVRDISEASIFDAYLLPKLYVKLHYCV

SEQ ID NO: 874765 - protein, 58 aa, Homo sapiens
MEAEVREQAKQRQMRIGNEVYVGTKMQVFVKKKKLCKARIESRLHSQQPIFFFQISTW

SEQ ID NO: 874766 - protein, 97 aa, Homo sapiens
RLGLHVPWNWQELGTGRSLSHSESGWQLPACRCSCPSHGCGPRHPCALGAWEQVGTPPSQVQLQPPKPQLQTGASRSTEQAGVLPHIPHSCTGPNCH

SEQ ID NO: 874767 - protein, 143 aa, Homo sapiens [sequence omitted]

SEQ ID NO: 874768 - protein, 154 aa, Homo sapiens
AQRASPALPTAALSEGLGHPEPRHESYPGFGAGLQEGAGQAGAARQGLPLEKGPDSIIKRTKEALALQCVEHGLSPGMASYTYNPLEPRVLPLHATTFSEIDLTSSSDVFSIQEVKHRDIWTLRTAVWIFLFDLCLHGVPQKAESQIKYICYIF

SEQ ID NO: 874769 - protein, 76 aa, Homo sapiens
NSSVLLSGLFMADRAGRKWILTDKATGGFIFGERRKQLEDRVTVRLSFQALLPAWMVGFLYCAVPLTRSPDSFSNH

SEQ ID NO: 874770 - protein, 104 aa, Homo sapiens
ASFTKRLSWLMGECQAPPRDREAQCRLWSYPDLTVKTHHPEWGPGQASAQAGPAQRLDSDSLCLSHRPETLLLPAEAVPCLPWRPGFLEKLCARGREFPSNLSH

SEQ ID NO: 874771 - protein, 132 aa, Homo sapiens [sequence omitted]

SEQ ID NO: 874772 - protein, 158 aa, Homo sapiens
MAAATHNKQKAKTGANPQHRARRQKRVPLTQKGQTKRRGRHPADRQRSQSDKTTTVSDKQAETGATAEPKSRAEEGDDMMKESMSEEARGKEADGGQQETEQHTAKDTRNRKAEPERRTDSQTTRETEEGESNRATDKRTRRATSLETNEEQPRASAT

SEQ ID NO: 874773 - protein, 107 aa, Homo sapiens
AKAERLDSLRQGQLAQQVGPETRLLFVSGGKSLMVKGSWNPKPRSLKGNLVDTRNHCKSLTGKNRLKVAVQRGCLWKQFFVGWNQEGRNLKQEERNGRCGDSHLSSQ

SEQ ID NO: 874774 - protein, 189 aa, Homo sapiens
SRPRPRTPSRGPSDLRFRGEAGLRRVFLKKAGGSVSFSDVAVGFTQEEWQHLDSAQRTPYRDMMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRN

SEQ ID NO: 874775 - protein, 520 aa, Homo sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRYGVEPAVLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 874776 - protein, 272 aa, Homo sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQGEGGIKGCLAACSVGRTTRLGPRRGGSQAQSPRALWRRALSLPGTCVLPSPCRASSRPFPAHQAGETGPTVCGYMGLDSASGSATETQKLNFEQQPDSREFGCAKTLYISDADKRKHFRLVLRLVLRGGRELGTFHSRLIKVISKPSQKKQSLKNTDREQGGA

SEQ ID NO: 874777 - protein, 41 aa, Homo sapiens
MLGAVESTGNKAQGRFILLWQVAITKLSLGYRGEECCFLPA

SEQ ID NO: 874778 - protein, 123 aa, Homo sapiens
MAAKGAGGDAPGRGLAGSGTKLPKAAASVNCAWQGGSHTGSDPRRWLPRGDWRQCLPPMWASGLGSPELCPAAGCTERGGLLNGPCPRGASGKEIHLHPQNTPCPLEALGAGCPSNREKPHAV

SEQ ID NO: 874779 - protein, 123 aa, Homo sapiens; identical to SEQ ID NO: 874778

SEQ ID NO: 874780 - protein, 102 aa, Homo sapiens
QHPLKHEFPQAEAALYLTPSASTAAGETAQPASPLGTICSHNQGAMLPKTWNLEPGNTKIPELGCTKIPEPGCTKVLESISTKVPEPHPSTVTSGPAQQKSK

SEQ ID NO: 874781 - protein, 103 aa, Homo sapiens
CHMQGPLLQAWLFCSSEAQGLPAFSNNTGTCFPFSLSPWMPPEPSLQACPLLDLSTKTSLHQSLSPPRLSFPPLFPTLHVSLWATFPNGFCHHLSSADTQISF

SEQ ID NO: 874782 - protein, 1037 aa, Homo sapiens
VVWVEFRRSMARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVTLDSYPVLNLVNLLKDLFETLKSRNCAIELKTNHRAESQLIVDNATRISRRQFPKFDAELNISDNPTLPISIQDKTFIFVRLPEEDASSQSSKTNHHSCLYSAVKTLLQENNLQNAKTSQFIAFRRQDCDLINDCCCKHYTGHLTKDHQSRLVFGIGDKICCTRNAYLSDLLPENISGSQQNNDLDASSEDFSGTLPDFAKNKRDFESNVRLCNGEIFFITNDVTDVTFGKRRSLTINNMAGLEVTVDFKKLMKYCRIKHAWARTIHTFQGSEEQTVVYVVGKAGRQHWQHVYTAVTRGRCRVYVIAEESQLRNAIMKNSFPRKTRLKHFLQSKLSSSGAPPADFLSPRKSSGDSGGPSTPSASPLPVVTDHAMTNDVTWSEASSPDERTLTFAERWQLSSPDGVDTDDDLPKSRASKRTCGVNDDESPSKIFMVGESPQVSSRLQNLRLNNLIPRQLFKPTDNQET

SEQ ID NO: 874783 - protein, 1052 aa, Homo sapiens
VVWVEFRRSMARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVTLDSYPVLNLVNLLKDLFETLKSRNCAIELKTNHRAESQLIVDNATRISRRQFPKFDAELNISDNPTLPISIQDKTFIFVRLPEEDASSQSSKTNHHSCLYSAVKTLLQENNLQNAKTSQFIAFRRQDCDLINDCCCKHYTGHLTKDHQSRLVFGIGDKICCTRNAYLSDLLPENISGSQQNNDLDASSEDFSGTLPDFAKNKRDFESNVRLCNGEIFFITNDVTDVTFGKRRSLTINNMAGLEVTVDFKKLMKYCRIKHAWARTIHTFQGSEEQTVVYVVGKAGRQHWQHVYTAVTRGRCRVYVIAEESQLRNAIMKNSFPRKTRLKHFLQSKLSSSGAPPADFLSPRKSSGDSGGPSTPSASPLPVVTDHAMTNDVTWSEASSPDERTLTFAERWQLSSPDGVDTDDDLPKSRASKRTCGVNDDESPSKIFMVGESPQVSSRLQNLRLNNLIPRQLFKPTGSGGSVEGLLQKVLDKHWKI

SEQ ID NO: 874784 - protein, 95 aa, Homo sapiens
VVWVEFRRSMARSSPYLRQLQGPLLPPRDLVEEDDDYLNDDVEEDEESVFIDAEELCSGGVKAGSLPGCLRGEEGVCPGDGVGGSKVALPILALP

SEQ ID NO: 874785 - protein, 65 aa, Homo sapiens
PLRVLLNPTGTLEPMSIILLGVIPPKGPENWGIHAPISTRLWPRLCPGVFRFLAFLACCMRGQSG

SEQ ID NO: 874786 - protein, 423 aa, Homo sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFTCSEPFHSSQVISWTSGHHILQQPPSHTPPSCAAGSMDKGLHAGGGGLLLSPQLSRLPSTAGDKEAQGPPPSCLIVLRVTKKPKDHLLPASL

SEQ ID NO: 874787 - protein, 413 aa, Homo sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFTCSEPFHSSQVISWTSGHHILQQPPSHTPPSCAAGSMDKGLHAGGGGLLLSPQLSRLPSTAGDKEAQGPPPSCLIVIKFPTL

SEQ ID NO: 874788 - protein, 62 aa, Homo sapiens
MEVSPVQSRLMSPKQYKDLGREWIGTGLKKSESKGTGLLVPSAGHTNEITRSLLPPLCHGAM

SEQ ID NO: 874789 - protein, 143 aa, Homo sapiens
GIRAVLKAPGVGAVVTRSAQGGTHGRGCAAGGQGANEGPGVPGQGLRLPPGDNGKENCVARFVPLVRSPRGSLEGPLSSFGPSDPQRLCLPHPGLPPQSLGGQASAPLLCCSFPQRTASALSTSRPCTCPHLSTPQAQLGPLF

SEQ ID NO: 874790 - protein, 101 aa, Homo sapiens
SGTAGSGAGRWLFARVVSTSSEGVHVLWAAPQMELGLPWTEYWVIRLQTAILKTSSPRLVQEIHCSVSAFLPSLLSNDSSRFSTEESLVPHGMCATGHSPP

SEQ ID NO: 874791 - protein, 69 aa, Homo sapiens
LIRKEKIWYAEVAKTYSKNESSIHRIVKKEKEIHAVLVIYCGSWDLSPWDKGVLWSYHTIQQPQSLVMT

SEQ ID NO: 874792 - protein, 109 aa, Homo sapiens
FRALSSRIAAGVFTVLPAGTHASDRSPIAYEMRRYHMSIPKYRPPLGLFPKAIAKGTVSVPGPVSCINCSAPGVAIQAVTATVARHRPGQALPPPPPSPLVDVDMIVCD

SEQ ID NO: 874793 - protein, 65 aa, Homo sapiens
GNIKKDVDIRPAALKLEEAPESSGGLLETGCAHTCNPSTLGGQGGVDHKVEIETILAKTVKPRVY

SEQ ID NO: 874794 - protein, 82 aa, Homo sapiens
MSHQEGSTDGLPDLGTESLFSSPEEQSGAVAATEASSDIDIATSELSVTVTGDGSDSRDGGFPNDASTENRSSDQESASEDI

SEQ ID NO: 874795 - protein, 55 aa, Homo sapiens
SSFLPSRGLGVCVPIASSPGGLENQWGHVGEGKKKTVLNSLDKRQCIPNVIKADG

SEQ ID NO: 874796 - protein, 275 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 874797 - protein, 324 aa, Homo sapiens
MIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 874798 - protein, 400 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 874799 - protein, 400 aa, Homo sapiens; identical to SEQ ID NO: 874798

SEQ ID NO: 874800 - protein, 69 aa, Homo sapiens
WAWSAPLLPPSCSLPEHAEADTFFCFTNLMAEIRDNFIKSLDDSQCGITYKMEKVYSTLKDKDVELYLK

SEQ ID NO: 874801 - protein, 400 aa, Homo sapiens; identical to SEQ ID NO: 874798

SEQ ID NO: 874802 - protein, 366 aa, Homo sapiens
RNIKLAGRGGGRLWSQLLGRMRQENGVDPGVGACSEQRSLHCTSAWATVQDSISKTKTKTKNNAYGESWGLLADGMAKTSTLSNKIISCSLFDRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 874803 - protein, 320 aa, Homo sapiens
VTLRFPNVNKRRKDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 874804 - protein, 72 aa, Homo sapiens
VTGYVDHAPRVPGGRRRRRQRRRQRRRRRRRLGGPEVNTMSSLHKSRPSFSVSTSLPVSFHLLPRVGLCLAS

SEQ ID NO: 874805 - protein, 86 aa, Homo sapiens
PLKSRMWHVMEIHRVPKSRNPQPWGSPGNSRNEKNLVEWTGIGIDTVAPRAMAVETASNQPRGHSLILSGPCKTWALPRWESLYSQ

SEQ ID NO: 874806 - protein, 105 aa, Homo sapiens
MRLRGPSGLPWAAAPSLAPRAPRGLRGGGRGRCACPPGSALHLPPPCPAAPAAPRPPRSLLQPDFLFAAADPAHFPGREAAEGRELLGGSPARSAPPPASPISLR

SEQ ID NO: 874807 - protein, 113 aa, Homo sapiens
CTYGRCGGAHGLCESISVGPACQAVRGHLCVKGVKLSCSILGSSWGPPHPTAPRQQSTGCSTYLCDKDSRTPLQILPQILSDKATLAASSREGTWDRKRQRGTSSPTAAEWQL

SEQ ID NO: 874808 - protein, 149 aa, Homo sapiens
SLLGGDRACSVECLPISHSSKGRLLTFVLVKGQRTCCVLERLSVRVENPCCVLERLSVRVESPCCVLERLSVRVESPCCVLERLSVRVENPCCVLERLSVRVESPCCVLERLSVRVESPCCVLERLSARVESPCCVLERLSLRVESPCC

SEQ ID NO: 874809 - protein, 105 aa, Homo sapiens [sequence omitted]

SEQ ID NO: 874810 - protein, 43 aa, Homo sapiens
MQDPLLRPPVSCGDTLTKGKAILGQRVSPVEERSTTHSVLLKT

SEQ ID NO: 874811 - protein, 81 aa, Homo sapiens
IHVIYIEPNDGDDTVACTSAPCLLPCAKMLRQYGFLSSLIHCTNSMQGSVPGAVGDEEVDAALLCPRRPYRPAEHRRQRHG

SEQ ID NO: 874812 - protein, 666 aa, Homo sapiens
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 874813 - protein, 666 aa, Homo sapiens; identical to SEQ ID NO: 874812

SEQ ID NO: 874814 - protein, 143 aa, Homo sapiens
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYSIQIGA

SEQ ID NO: 874815 - protein, 123 aa, Homo sapiens
FKRIRHCNIQHASKVLLLYGWRGEKQTVRRKATLKKQTKTTSQIFMWLLQSMVLQLIFPPHNVSLFFNCFLKNKYCFHFIFYLFFEMEFCSCCPLPRLECNGMISAHRDLRLWGSSDSPASAS

SEQ ID NO: 874816 - protein, 94 aa, Homo sapiens
ENRLKLGSGGCSESRSCHCTPAWATRMKLHLKKKRENDNEQSPLENYEEFQDSNSRALNGAQGPSAHKALGSSPQVARLCCRPYGSLRNYAPRS

SEQ ID NO: 874817 - protein, 73 aa, Homo sapiens
LGTGGRTRVSPGSTKWDVRTPVPITLGESILSSLGLIHEARASLQRPDVLTASDTHHTRNTSGGTSLSPAHTL

SEQ ID NO: 874818 - protein, 248 aa, Homo sapiens
RKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRREDCPQDIYNVMLQCLGSQARGQTHVCALRDFLLEAQPTIHAGLQDFEEPDKACTSMIEYDVITVIVGKGRGTTGGKWPRTHGPLVVWGPSLANVVTSGGRDCRAKDIKQPLQ

SEQ ID NO: 874819 - protein, 66 aa, Homo sapiens
LLHVMDKKTGAQRGEVTSSRPPSRTVTELGSHGNPGFLAVEEGEVTDVCELHAPQFAGGGHPSFPQ

SEQ ID NO: 874820 - protein, 137 aa, Homo sapiens
FSQVTGTGLVWLASCRSSQPGAQFFLGEHLCLQVTPLWSLPEVQLGSKCGPFPSTSRLFQHREAAFVSPPSPLSRALVPPGPCCLGLSCPPGKTCPSTEEERVQVPTWLEVVLAPSRAFRPMPTGCRHERVSSPVLS

SEQ ID NO: 874821 - protein, 545 aa, Homo sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVPVGDQGQELLCCKMALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 874822 - protein, 513 aa, Homo sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVERTGLVSERCGLFPPEIPDRSEGHSFKVQEFFISFCTVNLLGSKGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 874823 - protein, 118 aa, Homo sapiens
GETGFHHIGQAILKLLTSGDPPSWASQNAGITDRSHHTWPGTFYKCHTTCSVQPRLPPLCQRISCRVPRHQPHMAARKGSTHLRLVPAECLPGSGPGRAGPGPAWWHQAALEIRVGEQ

SEQ ID NO: 874824 - protein, 117 aa, Homo sapiens
KCSSRVGVTQFSRCHLSSLSLARKGNSLTPCASPVRRCLALLQLTPGAPLPLSCTHCPKIPSEMNLVPQLEMQKSSVFCVAHAESCRLELFLFGHLGTAPDFHSLYYFCHRFFFYVF

SEQ ID NO: 874825 - protein, 93 aa, Homo sapiens
LTPLPQAAAQNRTEDWSTETRFCLRSVVLEAGAGHVCPSFLYSQTLIAGPILCPQTSSRAMGSPAAIGQRHGREPVAMAEVTVGTERRFELQT

SEQ ID NO: 874826 - protein, 113 aa, Homo sapiens
YEWGRSAGNGLDELPEGPALPQNHPPRKAHAHLHLFLFLKRQGLPLLPRLQCSGTITAHCSLKLLDSSDPPTSASQVAWTIGVSHCPWPQFHLHENGKPLFRSKDGKGTSCRK

SEQ ID NO: 874827 - protein, 117 aa, Homo sapiens
SRRRLSVFVSSLSSRRLVSPRLSGLSLCLCLSVSLSTSLSVSLCLCLSLCLCVSLSVSVSLSLSLCLSVSLCLSVSVSLSLSPPTALCPSAKLLQNSSLDSSSQGICSWCQPTPPMQ

SEQ ID NO: 874828 - protein, 112 aa, Homo sapiens [sequence omitted]

SEQ ID NO: 874829 - protein, 80 aa, Homo sapiens
CDYDCPAEPTFKQDTILTNAKTEEGFSQRIHFATVLCVCLAIRESEEGGVQPDTSHEHSCLLPRALATRWHHAATRVPPV

SEQ ID NO: 874830 - protein, 105 aa, Homo sapiens
CAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVN

SEQ ID NO: 874831 - protein, 66 aa, Homo sapiens
KPFRSPAQPDDGIDEAEASNLLFDEPIPRKRKNSMKVMFKCLWKNCGKVLSTAAGIQKHIRTIHLG

SEQ ID NO: 874832 - protein, 71 aa, Homo sapiens
DPRRADGNRSRRKQRGPEGRGREDDPNRPGCSQSGTVRGRHPVPSRTQDGDGDGVRLGKDRAGELRGGMLQ

SEQ ID NO: 874833 - protein, 378 aa, Homo sapiens
MDSQELKTLINYYCQERYFHHVLLVASEGIKRYGSDPVFRFYHAYGTLMEGKTQEALREFEAIKNKQDVSLCSLLALIYAHKMSPNPDREAILESDARVKEQRKGAGEKALYHAGLFLWHIGRHDKAREYIDRMIKISDGSKQGHVLKAWLDITRGKEPYTKKALKYFEEGLQDGNDTFALLGKAQCLEMRQNYSGALETVNQIIVNFPSFLPAFVKKMKLQLALQDWDQTVETAQRLLLQDSQNVEALRMQALYYVCREGDIEKASTKLENLGNALDAMEPQNAQLFYNITLAFSRTCGRSQLILQKIQTLLERAFSLNPQQSEFATELGYQMILQGRVKEALKWYKTAMTLDETSVSALVGFIQCQLIEGQLQDAD

SEQ ID NO: 874834 - protein, 57 aa, Homo sapiens
SRDPDYHLTYPPPCAKEYHLYQFHSFLTLQLLKIMHHSWHHIWALTMFYSQLSVSTG

SEQ ID NO: 874835 - protein, 466 aa, Homo sapiens
QKIAVDCVIDLTRAEGENRPIATLDLTLEPVTPSQREPTSLQTCASLSGKAVMEGQVDRSSQPTARRLINSDPVDLDLVEENTFVGPPPATSISGGSVYPTEPNCSSATFTGNLSFLASLQLSSDVSSLSPTSNNSSSSSSNQKVPLPCPQQDVSRPPQALPCPLRASPCPPRALSCPSQTMQCKLPALTHPPQEVPCPRQNIPSPPQDSLWHPQHSPSPPQDSLGLPQDVPGPPQSILHPQDVAYLQDMPQSPGDVPRSPGTMPPSPDVPQSTGDMLGSPGDVPQSPSYVSPSPDAPQSPGGMPHLPGDVLYSPGDMPHSSGDVTHSPRDIPHLPGDRPDFTQNDVQNRDMPMDISAASPPSCSPSPQSETPLEKVPWLSVMETPARKEISLSEPAKPGSAHVQSRTPQGGLYNRPCLHRLKYFLRPPVHHLFFQTLIPDKDTREQGSKIRTHPSSKTKNGNKYH

SEQ ID NO: 874836 - protein, 70 aa, Homo sapiens
FVTSLRLKMCPRAIVERARRLGSLQSRVLGATPTVMTVRSLRTLPSVLRVAGTRLLPGESLCFRARQIQV

SEQ ID NO: 874837 - protein, 422 aa, Homo sapiens
KKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANYQQG

SEQ ID NO: 874838 - protein, 178 aa, Homo sapiens
KKHKKHKSDKHLYEEYVEKPLKLVLKVGGNEVTELSTGSSGHDSSLFEDKNDHDKHKDRKKKKKKKKTFGLRAPAGPREESFLKHTLAVGARGGPSVGIGETVGQRGSPEETAGHGHMRAWGFLHQFKNAPGGKREGFLVKKFPKRGDSGEAQKGDLYKRGGPKGKPAKFKFSPSRGG

SEQ ID NO: 874839 - protein, 367 aa, Homo sapiens
MIVFVFEEAGVVPRAARGEFGGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANYQQG

SEQ ID NO: 874840 - protein, 431 aa, Homo sapiens
TNTSTRSPDFNRRAFLSFLFFFEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANYQQG

SEQ ID NO: 874841 - protein, 107 aa, Homo sapiens
RDCATALQPGLQSETPSQKKRKEVNMVFMNLISISASSCYCNYHGLSGLNNIYFSLFWKLSPRSRHWQIPCLFLLADGHLLAVSTCGGEITCLMSFLRRALISSSGL

SEQ ID NO: 874842 - protein, 87 aa, Homo sapiens
ANSFTRGINTEVVLAGMEIWTEGDLIDVTVDLQITLRNFNHWRQEMLFHRAKHDVAHMIVGHHPGQNMGQAFLSGACSSGFAAAVVI

SEQ ID NO: 874843 - protein, 267 aa, Homo sapiens
IGSTGIKMSNRVVRWEASHSGNWYTASGPQLNAQLEGWLSQVKSTKRPARAIIAPHAGYTYCGSCATHAYKQVDPSITQGIFILGPSHHVSLSQCALSSVDIYRTPLHDLRIDQKIYRELWKTGMFERMSLQTKMNTVIEMHLPCTAKAMEIHKDEFTIIPVLVGALSESKEQEFGKLFSKYLADPSNFFVVSSDFCHWGQRFRYSYYDESQGETYRSIEHLDKMGMSIIEQLDPVSFSNYLRKHHNTICGRHPFRVLNAITELQKN

SEQ ID NO: 874844 - protein, 71 aa, Homo sapiens
GQRAEQVTVEGAPLRGSSQGRPQGCDISKEPRGGEEAKGQACPRAHHIKPGETAAPGLDPQPSVRPIWKEE

SEQ ID NO: 874845 - protein, 73 aa, Homo sapiens
ISALSGPFLFSYLPPGLKAGKGGTEMGLQFLIPRARVLPFSHLGHPTSPETQQCGRGSLGLQMDGPGCIWLCH

SEQ ID NO: 874846 - protein, 140 aa, Homo sapiens
QWSATTAWNPQYWSLCHPAGVSRSAPDHPQRPGHLWFWGPEALGSPSCWCDLLQLLPARQGELRAELALCPGGWTLAGHGPEEGARPPRVSVLRSAGTGPPPAGEATRVGHLLLPDPSSQGAYPPLQGWCYSPEGQRGSS

SEQ ID NO: 874847 - protein, 628 aa, Homo sapiens
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTIMPYNSAHHCVVEVENFLFVLGGEDQWNPNGKHSTNFVSRYDPRFNSWIQLPPMQERRASFYACRLDKHLYVIGGRNETGYLSSVECYNLETNEWRYVSSLPQPLAAHAGAVHNGKIYISGGVHNGEYVPWLYCYDPVMDVWARKQDMNTKRAIHTLAVMNDRLYAIGGNHLKGFSHLDVMLVECYDPKGDQWNILQTPILEGRSGPGCAVLDDSIYLVGGYSWSMGAYKSSTICYCPEKGTWTELEGDVAEPLAGPACVTVILPSCVPYNK

SEQ ID NO: 874848 - protein, 590 aa, Homo sapiens
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTIMPYNSAHHCVVEVENFLFVLGGEDQWNPNGKHSTNFVSRYDPRFNSWIQLPPMQERRASFYACRLDKHLYVIGGRNETGYLSSVECYNLETNEWRYVSSLPQPLAAHAGAVHNGKIYISGGVHNGEYVPWLYCYDPVMDVWARKQDMNTKRAIHTLAVMNDRLYAIGGNHLKGFSHLDVMLVECYDPKGDQWNILQTPILEGRSGPGCAVLDDSIYLFLFYIFIIFSNSSTIF

SEQ ID NO: 874849 - protein, 61 aa, Homo sapiens
MVQQIQSVCMECQAHGETIRPKDRRDSCNGRKTVAEKEILEVHIDKGMKDGQKITFRGEGY

SEQ ID NO: 874850 - protein, 115 aa, Homo sapiens
PIIPPPCWFPLFSISDASQGMDCPQPPNMHLSKYSLALGSITPRRVPEFLEPNVLEFQISGTCPTGALRLLPYCFPAFLSGLHWFAWRSYLVSYVFLHPLPDSAQNAHRLGSHQT

SEQ ID NO: 874851 - protein, 113 aa, Homo sapiens
QSVLERFPWLKYRQFGSLPEYYTQKSSPFTDPVARGVDGSFFSPPTSTAQTVSFPFKHSLMGMLCPLCGPGLVGSQISYKLLRGRKVEGNHPCRFFFSSCASIQPIKLLFIFS

SEQ ID NO: 874852 - protein, 247 aa, Homo sapiens
MECVEEEEEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKGFKEANNFLWPFKLSSPRGGMKKKTTHFVEGGDAGNREDQINRLIRRMN

SEQ ID NO: 874853 - protein, 123 aa, Homo sapiens
QDPQRPSQALGTCQASMSQPRGVLRRSSKLDPADPQIRPWPPRGRHDSQKPSLQAGVWGLPAQHNLGAVRHGGGSPPSQGRPGSTGYIFPHGVNKEPPLSPAVVSPGPRPCGSQQSRQPEREG

SEQ ID NO: 874854 - protein, 42 aa, Homo sapiens
YKVTPQAEVNVQVNQNEGSLRNSQKYPAGSCLLFAATKVFTY

SEQ ID NO: 874855 - protein, 155 aa, Homo sapiens
TQLSGARLTGKCLVSPWLVEGPMLAPETTMCLLRKDSWTPASLLQIGEGGNGEKGKISKIRPFPAPGREGALAPRARHCSPGGGGHLSRLHPSPWPGREEETPTGPFQAGAQPVGTLVKQAWVLQGERNLKPIGLGPQPSYHPHPGTLVLKTSIY

SEQ ID NO: 874856 - protein, 116 aa, Homo sapiens
LGVLRRCRSAVSARMSLQAGPHTGHSGAAPTGPPAEPASLAAHRRPAESCGRGGGCGGPSGPRALRGDQGAQCHGCADHLRLVLSGSRGGRPLAGSCGQWGSARSPGSHSGPCPQL

SEQ ID NO: 874857 - protein, 671 aa, Homo sapiens
SAEEEAHPSPPDDGDFLRTPRRWRQHWEEAVRRSAQERVRRPGAGWAFGEAEGASGLAQLLAELGGLVRRDLQKVRQEVQPAYAAAGFPAWEVYLRAFHSAVAQRLQELARDARGCEQLYILLDWAANVYGSPDFLGAPGLALPAEPLPPLLAPDVWARLESDYTSFLEAKIASCFDSILQLEQSHWAAAEVPEVLQGLYQAPLSMDVHMVLAREQGLRRGVCSSLTHTVAISRTNSYPVPTNPSVRWEPEAPRGGKSGTPGAPTGREAAGWEFAGVDSPVGRLKAGGAKTDRHSGAGWRRSGGYQGTRGLRSGAGGTLSAGLRSQLVAEHVKAAGAISAELEATTLRICTRALGLFVPRCGRILSRGATWPGALCRWEGGVCVGTCLGGWTQGHRAAREGPQRLCVSRPRFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTEDLLRAAAGAAGAEAPRGRVLFEEIKVPSAMAVLITCV

SEQ ID NO: 874858 - protein, 218 aa, Homo sapiens
LAPSSPAAKMPSPQTDTPGPELQSPKEAEEPQTPAQGSRRTSSRKEPNAHRKDGTRLGLGSLRQAFSRASQRALTQVSKEDTGLFRRSSCSLFRSFRQALNDGPATGHSQATPEVPSGVMNGVSQQASTGAASEELKPEAEGKSVADLITERQLLAAFEQLLRLETLLVAEKASRTFEQDPTAFARRAMDVCLLYDGLAAEIGAIVRETLDSDGVDAA

SEQ ID NO: 874859 - protein, 479 aa, Homo sapiens
LAPSSPAAKMPSPQTDTPGPELQSPKEAEEPQTPAQGSRRTSSRKEPNAHRKDGTRLGLGSLRQAFSRASQRALTQVSKEDTGLFRRSSCSLFRSFRQALNDGPATGHSQATPEVPSGVMNGVSQQASTGAASEELKPEAVLTSWAPRGWRCPPSRCLRSWRRTCGPDWRATTPASWRPRSQAASTASCSWSRVTGRPPRSPRCCRASTRRRCPWTSIWFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTEDLLRAAAGAAGAEAPRGRVLFEEIKVPSAMAVLITCV

SEQ ID NO: 874860 - protein, 513 aa, Homo sapiens
LAPSSPAAKMPSPQTDTPGPELQSPKEAEEPQTPAQGSRRTSSRKEPNAHRKDGTRLGLGSLRQAFSRASQRALTQVSKEDTGLFRRSSCSLFRSFRQALNDGPATGHSQATPEVPSGVMNGVSQQASTGAASEELKPEAVLTSWAPRGWRCPPSRCLRSWRRTCGPELESDYTSFLEAKIASCFDSILQLEQSHWAAAEVPEVLQGLYQAPLSMDVHMLVAEHVKAAGAISAELEATTLRICTRALGLFVPRFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTEDLLRAAAGAAGAEAPRGRVLFEEIKVPSAMAVLITCV

SEQ ID NO: 874861 - protein, 386 aa, Homo sapiens
MSRSRPQPPALSSSPDFLGAPGLALPAEPLPPLLAPDVWARLESDYTSFLEAKIASCFDSILQLEQSHWAAAEVPEVLQGLYQAPLSMDVHMLVAEHVKAAGAISAELEATTLRICTRALGLFVPRFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTEDLLRAAAGAAGAEAPRGRVLFEEIKVPSAMAVLITCV

SEQ ID NO: 874862 - protein, 70 aa, Homo sapiens
LAAFRGSRRLTELYVNECENTDDLDEFVEKYNVLSKEETETLNNPLTTKKKITSKVKNALTHTKSNLNRL

SEQ ID NO: 874863 - protein, 69 aa, Homo sapiens
MAYPHAVTMVYLNTVTMLYPQNVTTVYPHTVTTAHPHAVTTAHPHAVTTAHPHAVTTAHPHAVTTAHPH

SEQ ID NO: 874864 - protein, 1237 aa, Homo sapiens
MKRLLAAAGKGVRGPEPPNPFSERVYTEKDYGTIYFGDLGKIHTAASRGQVQKLEKMTVGKKPVNLNKRDMKKRTALHWACVNGHAVVTFLVDRKCLNVLDGEGRTPLMKALQCEREALCKYSQDAGADLNYVDVYGNTALHYAVYSENLLMVATLLSYGAVIEVQNKASLTPLLLAIQKRSKQTVEFLLTKNANANAFNESKCTALMLAICEGSSEIVGMLLQQNVDVFAEDIHGITAERYAAARGVNYIHQQLLEHIRKLPKNPQNTNPEGTSTGTPDEAAPLAERTPDTAESLLEKTPDEAARLVEGTSAKIQCLGKATSGKFEQSTEETPRKILRPTKETSEKFSWPAKERSRKITWEEKETSVKTECVAGVTPNKTEVLEKGTSNMIACPTKETSTKASTNVDVSSVEPIFSLFGTRTIENSQCTKVEEDFNLATKIISKSAAQNYTCLPDATYQKDIKTINHKIEDQMFPSESKREEDEEYSWDSGSLFESSAKTQVCIPESMYQKVMEINREVEELPEKPSAFKPAVEMQKTVPNKAFELKNEQTLRAAQMFPSESKQKDDEENSWDSESPCETVSQKDVYLPKATHQKEFDTLSGKLEESPVKDGLLKPTCGRKVSLPNKALELKDRETFKAESPDKDGLLKPTCGRKVSLPNKALELKDRETLKAESPDNDGLLKPTCGRKVSLPNKALELKDRETFKAAQMFPSESKQKDDEENSWDFESFLETLLQNDVCLPKATHQKEFDTLSGKLEESPDKDGLLKPTCGMKISLPNKALELKDRETFKAEDVSSVESTFSLFGKPTTENSQSTKVEEDFNLTTKEGATKTVTGQQERDIGIIERAPQDQTNKMPTSELGRKEDTKSTSDSEIISVSDTQNYECLPEATYQKEIKTTNGKIEESPEKPSHFEPATEMQNSVPNKGLEWKNKQTLRADSTTLSKILDALPSCERGRELKKDNCEQITAKMEQTKNKFCVLQKELSEAKEIKSQLENQKAKWEQELCSVRLTLNQEEEKRRNVDILKEKIRPEEQLRKKLEVKQQLEQTLRIQDIELKSVTSNLNQVSHTHESENDLFHENCMLKKEIAMLKLEVATLKHQHQVKENKYFEDIKILQEKNAELQMTLKLKQKTVTKRASQYREQLKVLTAENTMLTSKLKEKQDKEILETEIESHHPRLASALQDHDQSVTSRKNQELAFHSAGDAPLQGIMNVDVSNTIYNNEVLHQPLYEAQRK

SEQ ID NO: 874865 - protein, 36 aa, Homo sapiens
LGVQAQWVYLELCVCTGVVGALRAMCVCSHVHRSGG

SEQ ID NO: 874866 - protein, 229 aa, Homo sapiens
WSVLELRSSASLIQLSLRASQPSAPPLAPPLTRRPPRAAEPMRARAPSRLRGVAVVPERPGLARAWPRHERGAAAELEEKAASEPEAGAMPEKRAGAQAAGAPGYKGFGDQVCQCCYSIFRLRFFCRWGPGWNKLPIVDGSTLNTFSQHTFLMNGLIQGVKGLLSFLSAPLIGALSDVWGRKPFLLGTVFFTCFPIPLMRISPWWYFAMISVSGVFSVTFSVIFAYVAD

SEQ ID NO: 874867 - protein, 108 aa, Homo sapiens
GHQEKQALICRGAAQGVGAGDVPRQTEADLPSSLGPLHPTHHHHLILGFMQSCLLGRFPYGKIQGVQILEAPDKCTPSLNSTRIKKGHPPSQAPALFRIRIVPGTGDG

SEQ ID NO: 874868 - protein, 145 aa, Homo sapiens
VLEHHLKRIRTQPLSSWVKGTSVSLPGAWTNVIGAEFPLLWDTSNRGVVSQRSLGFLNKNVTFWLPRNVKNKECDRVAALSPPDPCERIDIVFLGSRREREPHSLISQIFPKCYIPGTILGMNKRDKVLGLMNLTMSVCIGGKIR

SEQ ID NO: 874869 - protein, 31 aa, Homo sapiens
MTGDEDQGSNSNLGAIITGSLTSTLSPLENS

SEQ ID NO: 874870 - protein, 77 aa, Homo sapiens
MEKLMYFSRQGVKQTGEPPPSGISAIKRNPLLRPTTQKDGPELRTSPLLKPSHNDRPAAMETHLLVSRVTMAAWPPR

SEQ ID NO: 874871 - protein, 70 aa, Homo sapiens
IPTSEGVLDGYRDVAGPCTSPERRIQPSWSARAWGGSGRRASCSEELRCFQGHLPDMGHSPRLFQVEMRC

SEQ ID NO: 874872 - protein, 91 aa, Homo sapiens
LGAAMCRMMESSGPVQGAGPGPWDQANLSHTQLCPEGPLELQQNLSNTPALGPHLSVRTTARDENAKDTPGMRTGLSRWRGTTASGSHALP

SEQ ID NO: 874873 - protein, 52 aa, Homo sapiens
TIPTLGATVSRWHGESASDFPGQVFVTKPGCQGLVHISLSLLGWAGAVPLDI

SEQ ID NO: 874874 - protein, 111 aa, Homo sapiens
QWKREAVVTVEREDSGEVEGRRVGQSSPHWQGQLGRAGPAFVCPRAWACLVKSLHTPRAGASQCRSWKVTPHSAGDNAGGPGVLPGKSVLCPAIGFVAEAPPLSSGLTSGH

SEQ ID NO: 874875 - protein, 293 aa, Homo sapiens
REGQEWWRWSQGVCGFWVPTCISSTLTPSSCPVLLKVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPPQPQAPPQQAAQPQVQAEQQQQQMYSY

SEQ ID NO: 874876 - protein, 178 aa, Homo sapiens
MQRVARLCVRSEPPCCPQGLLRVVSGFSAIQMYPFWLKPSQNPEWKKRGKSHIFLLFKLQFQRCTDVFIKEDIRSSHCGHQALWTHLSGEFVLDPWLRAAVDSSAIHWCESCGEATGKRSVPSAASLCPAWDCAGGSGVEGRPPVPLSFPFVASKGGRLMASPLEAASWAFPLDCERH

SEQ ID NO: 874877 - protein, 372 aa, Homo sapiens
GIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPPQPQAPPQQAAQPQVQAEQQQQQMYSY

SEQ ID NO: 874878 - protein, 372 aa, Homo sapiens; identical to SEQ ID NO: 874877

SEQ ID NO: 874879 - protein, 237 aa, Homo sapiens
MKPIFLQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPPQPQAPPQQAAQPQVQAEQQQQQMYSY

SEQ ID NO: 874880 - protein, 252 aa, Homo sapiens
RRPLRSRKMSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADET

SEQ ID NO: 874881 - protein, 180 aa, Homo sapiens
MCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADET

SEQ ID NO: 874882 - protein, 30 aa, Homo sapiens
MPGPVLGIVGTVERDVFDPKELLFQFRERD

SEQ ID NO: 874883 - protein, 75 aa, Homo sapiens
MRKSNHMLDIILPSWAESELQFKLLLLSLGFVCFQCGDIFQICSSPELGTPQLQLLSGQYLNIPTISEIECLPFL

SEQ ID NO: 874884 - protein, 61 aa, Homo sapiens
MCLISLHTQGTELRHYNSWSVSVSSWVLSRPPVTHRDPHMTSTQGPTPPAKPSADHNLQPA

SEQ ID NO: 874885 - protein, 131 aa, Homo sapiens
PRGHCPPAPAKPMHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYS

SEQ ID NO: 874886 - protein, 118 aa, Homo sapiens
MLPFPASLQQGRPPRVGGGEQSLQAATGTVHLVASRDRMAGAAVQTSVESASQPARRVQPRLCPSSEPCSQTLPVSQLLWLLHALSRGNGFAPTSTRAQEGPENAHPCHTEHRPPCSP

SEQ ID NO: 874887 - protein, 46 aa, Homo sapiens
MSLKAPNRRPCQGGVAGQEAKSSPAITGNQRPNTPARERQGTVSCR

SEQ ID NO: 874888 - protein, 165 aa, Homo sapiens
MCSALPFRTPVCTAGGLGDSASRQERQIATCSASFGCVWNLDYPTFSYKWTLRACLEVLQGKPSSSIGYGRSLRLSCSFGRDAHEAVRKEGDTRLASQISRINPGDQWDDRCRSQIALISGSSTFNLLWNLHSFLRCCAIYIPTNSAQRFTLVHVSNDELKTFMF

SEQ ID NO: 874889 - protein, 111 aa, Homo sapiens
ARGPARGTSHAQLMQVEGKGEGCLDAGPVHPFHPIQHLVLVWVLSSSFSTHTHTHTRNTQSHTSDAAPHVSPTSAFVQPQPLSSLRVWPHPLALHFFPAILLRLSIVSIMI

SEQ ID NO: 874890 - protein, 101 aa, Homo sapiens
KCSSPLGPHTSVSKLSPCPVGLWWSGLLTLVLQQFLAAGRGGAGPHYPWWVCKMALSASFSPQVYVLLGPHRPGLGQHVPLSGLFYWLLRPLLGWASHLVG

SEQ ID NO: 874891 - protein, 62 aa, Homo sapiens
EDVTSIPGPAQSTISPDISTRTVSWFSTSPVMTESAEITMNTHTSPLGATTQGTSTLDTSST

SEQ ID NO: 874892 - protein, 154 aa, Homo sapiens
SIHGCEILALFSPTLSSRFLPHSVFCPYTICVFTMNCSGKSSRYTGFPGEEGQRETHGPRSTGRIFIPTLAPQSPAWAGLSTPLAPGAALLAMGSTGWSMARGTACPPSKDRTLCGSLRVPPPRHLVCSTPCPGSLVWQEQEGSCPLRARSSTP

SEQ ID NO: 874893 - protein, 82 aa, Homo sapiens
QAPSPWRCRAGARGRLASGCCGHWTTSHAAASAREASQLRAPGRCPDLGCGFQTSLTTACPRTPDPGEDVPGGQATGSRAQQ

SEQ ID NO: 874894 - protein, 73 aa, Homo sapiens
LQKVRTEAQRGGDGNGPGRRHGDSGGDKAQSNSGHNSRARGFADGLAKECKGTAEPRALQHLRRPGGPGRWCQ

SEQ ID NO: 874895 - protein, 91 aa, Homo sapiens
TSARLQDACTCGQPQMRPHLPFRCSPPNWGTRRLFREPDVMIRSFYDQVLNQSSLEALRHRQHGQDQPGSDRRTSGVRKVAGHGDLRASSG

SEQ ID NO: 874896 - protein, 81 aa, Homo sapiens
ACIPTVPSCPGAVSPSQRNCMESPHGSHWSQTSDSELLSLCWVRGSAFILGAKLNSNLDEHTRPLVELFLLPLKVLLRSCT

SEQ ID NO: 874897 - protein, 70 aa, Homo sapiens
MFTDTEFHEAVVSRKPAAHRVHNEFPSSCLFLRGENSVRECLKLQTFMGNLLLHPLLSLNSSSFPSPLTR

SEQ ID NO: 874898 - protein, 68 aa, Homo sapiens
LKDPRWVVLAGGAGGGFSFPPPAPYREDDGVLRNTDGNTGLPCAQVDVHLWVRWDISLLACVAVHLEI

SEQ ID NO: 874899 - protein, 31 aa, Homo sapiens
MSSGAEMQAGVGRCCPSCLAMATAQTTQPPP

SEQ ID NO: 874900 - protein, 109 aa, Homo sapiens
PARLNHMSYCPIPFSWIVPIICPSDPSSAGPTRQAQSRECEGRVSRCPAEASLGSLPKSTQKVLLSGPSHPLSNSTSGLAARNLALQGPSVRPSVRPSIHPSIHPSIQQ

SEQ ID NO: 874901 - protein, 103 aa, Homo sapiens
GRLVQTRKSGYFPSSSVKPCPVDGRPPISRPPSREIDYTAYPWFAGNMERHQTGQPAANSTSFETYRMSVQHPQADRTAICHHQFDDKMNAPSAHRCRTPWFR

SEQ ID NO: 874902 - protein, 79 aa, Homo sapiens
PSVCGWRPKAPWAAVSASSRALRPKNLESDVQQEEEEKQASGMGRRKRARRLSKHIYPSSSTRPVLAALAPDWIVPIHI

SEQ ID NO: 874903 - protein, 95 aa, Homo sapiens
MRCSVATQNEPWTHTARRMNMQTSGHVKGARPRGATLCDSGWSLCAQDPAASSSSWLQGVLVSEERQAGVPRGRLEGLRNHFHLLSPPCLHCLGL

SEQ ID NO: 874904 - protein, 146 aa, Homo sapiens
LEGLPLGIQYFEKLNPDFLLEIVMEYLSFCPMQPASPGQPLCPLLRRCISVLETVVRTVPGLLQTVFLIAKVKYLSGDIEAAFNNLQHCLEHNPSYADAHLLLAQVYLSQEKVKLCSQSLELCLSYDFKVRDYPLYHLIKAQSQKK

SEQ ID NO: 874905 - protein, 115 aa, Homo sapiens
GLRASDRQGWQGVRAFSRARGHTCKIIKVRKTTGREGMEVALHGRILRKRVTWHNWPWGTFLLSSVRSWGKREKAGSSSLWLSDRGQPPALSRWGHAEKLWRRAGEAVRRRSLRG

SEQ ID NO: 874906 - protein, 181 aa, Homo sapiens
CLSLVCTPVSRVSSPCCRVTCEPSPCQSGCTSSCTPSCCQQSSCQPACCTSSPCQQACCVPVCCKTVCCKPVCCMPVCCGPSSSCCQQSSCQPACCISSPCQQSCCVPVCCKPICCVPVCSGASSLCCQQSSCQPACCTTSCCRPSSSVSLLCRPVCRPACRVPVPSCCVPTSSCQPSCGR

SEQ ID NO: 874907 - protein, 63 aa, Homo sapiens
EKTLSLLPFGKQVCGIWRLGILFTHFDPAGAEITASFPSGLEMRRTRSTCGLKQSGPAGSPDQ

SEQ ID NO: 874908 - protein, 142 aa, Homo sapiens
MGIQPETTKQLRDANILKESKRSISREDKGNVLKLSGLIEDLEDRSGNLNAFSSEPQKERIERMEERPYFQNRKHDVFVRLKAFNECQDRPSKNTPKRKRKPQSHQKDKAVHPQRHENQTGIWFLISNTGCSKMVPWYFSKR

SEQ ID NO: 874909 - protein, 80 aa, Homo sapiens
GLAKPVGMPQRPTADYRFTEKRYWARSRNLYPSGNVPALSTMKNMNLRPEVTVSFKCICRSVVWQKCAEQRGVQDIGQGS

SEQ ID NO: 874910 - protein, 119 aa, Homo sapiens
WGLGRHLGTWILGGFLPPPDKNGSISPFTQIMWFMPNTCFPSVSLEFGYAPSRGCLCDQPPNKNPRHCVSYKLPWLATLNVLLQGTAGEIMSCVTPQGEASDAYTWLLPDFTPGTLSLC

SEQ ID NO: 874911 - protein, 50 aa, Homo sapiens
MGPEQRGSVGHGKSENLLNTQWKLGMSEKHKSGTLISTTVSLAAGSSRER

SEQ ID NO: 874912 - protein, 36 aa, Homo sapiens
MFPPTNQWVVECSTVSPPSGQGAAKGRGHDSFLYKP

SEQ ID NO: 874913 - protein, 81 aa, Homo sapiens
SPLVLCHSSQHSPPCHCVTVSPHCHHSSSAVPHSTACRVTVSPCHPTVTARPLLFVPAQPAVSLCHRVTPLSLLVLCCSSQ

SEQ ID NO: 874914 - protein, 66 aa, Homo sapiens
FTRGSHDTSRATTPGLQLRTRGTEAERLPLAPEQWVEEPLTQGQSCMKSTFCIHKIQQDVWRTRRA

SEQ ID NO: 874915 - protein, 48 aa, Homo sapiens
MAAEQANGFRYNQAHVAASSVPDTPVPALSTQAKPLHGLLSGKRWASF

SEQ ID NO: 874916 - protein, 151 aa, Homo sapiens
PNLCMKSISLVFLFSLKNISGFYWLPSISLPPSSSKPPYFLPGLLQLLSTTNSCYPVSICSQTGISFAMPTSLWNPLLIASPSVAYRVQHDLARLRPPPPLIVLQLVQGSWDSAVLSRSLPQGSKRTLSSSRCLMNSPHSCWTQTICLFLG

SEQ ID NO: 874917 - protein, 102 aa, Homo sapiens
RFANSFAPHNNPMRSVILSSFFKDEEIETERLVNFLKVPQLAYGKARFEPRQTSAASVLLSSSLSYSSFRPSSSPTYTIKATPFSLHKTLAKSTVPWRRREP

SEQ ID NO: 874918 - protein, 99 aa, Homo sapiens
EHFYVTGPKNPGPQQDTRVNAWSQRLTRRINFPSQSSFGLGLDMTYFSRLGLTRLCDEWTKYTSHNHSKKVKTGALKISRPNCQKTIIFTDKERETKYL

SEQ ID NO: 874919 - protein, 39 aa, Homo sapiens
GFLKGQFVPSPDIPMDRRGAVLVVFVMLQPSKNGSTGQS

SEQ ID NO: 874920 - protein, 132 aa, Homo sapiens
CRDGEDHRRRVLLPVPPALETSTPIPRCPSRPIVHVFKGAAWIGVCVCSAQVWWWHPEAVGPLVCVHTHVAHCVVTMVIIVGSRRKRDHSTYTKGTLDRLQGKRPRAKLLSQRWPLTPPPAPAHQPAPLIPC

SEQ ID NO: 874921 - protein, 118 aa, Homo sapiens
PQGSQAVPCPQVALLGQLPCPGTERLLGCTGTALAAQVQIWGKKRNFWQPTGQSLRVVCAQDEGPLIGTGRSRACCLRLCGSLKANQYDMGDRDEFEGLKCALVRRTDTWESSKSAVS

SEQ ID NO: 874922 - protein, 51 aa, Homo sapiens
RNEGVHLGRFGTDYLTIQGILAQVSMAAICFVDGYGWHFTHYLNFDIPTVD

SEQ ID NO: 874923 - protein, 70 aa, Homo sapiens
SAPPPGGSSDPGLWGLQNCIQALHLQSGTLHLQLGTLHLQLGTLRPDRGNDLCKGKQTVCDFFYASVMPR

SEQ ID NO: 874924 - protein, 209 aa, Homo sapiens
MASLTLNEELLYRVVPRDQDFQENYAGIFHFQFWQYGEWVEVVIDDRLPTMNGQLLFLHSEQGNEFWSALLEKAYAKLNGCYEALAGGSTVEGFEDFTGGISEFYDLKKPPANLYQIIRKALCAGSLLGCSIDVSSAAEAEPSPPDAGKSHAYSVTGVEEVNQGHPEKLIKTQEYMVKWKCPGAWTDDATKVDSIDRPEGEPKKVEGWR

SEQ ID NO: 874925 - protein, 121 aa, Homo sapiens
QDGLQRPGGPSVFLSLSLVPVLREKIQHGGQSKAPSLLCAGSSGFGVGNQNQGPRVRREPSALHPDQDGAALGRLGESPRRGFLARSWVCRVSLPMRMLRRTQVSHGLGTNPDLQRGPVVV

SEQ ID NO: 874926 - protein, 454 aa, Homo sapiens
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 874927 - protein, 436 aa, Homo sapiens
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 874928 - protein, 150 aa, Homo sapiens
MKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRGAWSLLLPWASAFDRLCPLRLPRTFATGHFLRPATRSKKAQEGPHRG

SEQ ID NO: 874929 - protein, 436 aa, Homo sapiens; identical to SEQ ID NO: 874927

SEQ ID NO: 874930 - protein, 436 aa, Homo sapiens; identical to SEQ ID NO: 874927

SEQ ID NO: 874931 - protein, 438 aa, Homo sapiens
MLLRLQRIKTLRPPGCPHPMTTCSAGTLSAVPCVSPRQVFVFERRFCLWHSHVEMFTHVLPFVISADTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 874932 - protein, 186 aa, Homo sapiens [sequence omitted]

SEQ ID NO: 874933 - protein, 436 aa, Homo sapiens; identical to SEQ ID NO: 874927

SEQ ID NO: 874934 - protein, 310 aa, Homo sapiens
MKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 874935 - protein, 387 aa, Homo sapiens
MARTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 874936 - protein, 310 aa, Homo sapiens; identical to SEQ ID NO: 874934

SEQ ID NO: 874937 - protein, 197 aa, Homo sapiens [sequence omitted]

SEQ ID NO: 874938 - protein, 419 aa, Homo sapiens
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGRPRVRDPRVR

SEQ ID NO: 874939 - protein, 121 aa, Homo sapiens [sequence omitted]

SEQ ID NO: 874940 - protein, 178 aa, Homo sapiens
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLPVCAVNQQRQLLLGVPRERDHRRGAGLRYH

SEQ ID NO: 874941 - protein, 436 aa, Homo sapiens; identical to SEQ ID NO: 874927

SEQ ID NO: 874942 - protein, 425 aa, Homo sapiens
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 874943 - protein, 436 aa, Homo sapiens; identical to SEQ ID NO: 874927

SEQ ID NO: 874944 - protein, 436 aa, Homo sapiens; identical to SEQ ID NO: 874927

SEQ ID NO: 874945 - protein, 395 aa, Homo sapiens
FIDLFQLIPEETDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 874946 - protein, 197 aa, Homo sapiens [sequence omitted]

SEQ ID NO: 874947 - protein, 155 aa, Homo sapiens [sequence omitted]

SEQ ID NO: 874948 - protein, 279 aa, Homo sapiens
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPQRSHNWTGTREVS

SEQ ID NO: 874949 - protein, 160 aa, Homo sapiens
MEIIKDYIFPVDTTACGKSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGSADETDFKSIDPKPSCLPTDAGHVT

SEQ ID NO: 874950 - protein, 146 aa, Homo sapiens
RHRSGGKAGLRGASDRWPLWWSWGSSRHTSPEDPEAASRRRNALIVSLSLCLSISVSLRLCLSLHLCLPVSLSVSVSLCLCLSISFSVSLCLSVCLSVSPSVSLSLFPSLSLHLCLCPCLCLSVFLCVCLCLSPSLSVSVPVSVSL

SEQ ID NO: 874951 - protein, 75 aa, Homo sapiens
VRLLLLHGVVAKVNNIFVGKDLRKGAKVAQLLSTQWADLICIPTLCWPWVLASMCHSASAGRPVILSTFAHFLLH

SEQ ID NO: 874952 - protein, 176 aa, Homo sapiens
RGRYTHTRRSARALGIGKRCGFQPRDSGRAKIRVTASVPPSVKWDPGGSDPQGCGWRQRRSSGLRTPGPRDPPVPLWKLARGPEGGSPGHLPRPLTQVWMFPEAQGHHWAPPGTDERPLAGKGAGSGRQQAPEPPAHAGTGSPSNAPPSNFSTRDGKRREKEERFPPKLHCGRIPL

SEQ ID NO: 874953 - protein, 67 aa, Homo sapiens
QSPRQCEQGRGLYACVRMFFSSKRQLWAIGPGTQDLDNHHHSPTHSPVSVAVKVTGQKRQASTLSMP

SEQ ID NO: 874954 - protein, 71 aa, Homo sapiens
SHVVTEGLGPRHRVQSVLEVSEELLESKLRAVSSPHPPWVPAPELGCAQPPSDSEAVHTRVLLKDSGFCFL

SEQ ID NO: 874955 - protein, 70 aa, Homo sapiens
RALLGMSIVRHHRGHQGLVERESKAPGLLREGPDRRRFGGKQNLCLLIAPKPHAPLPRLSCCFPDLLRDL

SEQ ID NO: 874956 - protein, 286 aa, Homo sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 874957 - protein, 275 aa, Homo sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWNEEADRLAREGAKQSED

SEQ ID NO: 874958 - protein, 170 aa, Homo sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPL

SEQ ID NO: 874959 - protein, 286 aa, Homo sapiens; identical to SEQ ID NO: 874956

SEQ ID NO: 874960 - protein, 73 aa, Homo sapiens
GDRKCGVERRRLAPTLGRESKCFPVPGVSDELASVPGPQSRLGRLALPPRLSRVRDVLCREEGPQDRGLSDLE

SEQ ID NO: 874961 - protein, 105 aa, Homo sapiens
TAHTDLFPASAGPQIPVQTGLFHAHVHTHIHEGCCQQISLFLKPSISLPLCLLILVNVHLRGHFNKLSSIHPFKTFHFLQFSLDIPLGLLYKCHVHHALASPSLL

SEQ ID NO: 874962 - protein, 241 aa, Homo sapiens
FFHPSPPPSSPETRDFATTSIGDAELRGTGLRRDGSKKCCGNRQAMNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 874963 - protein, 127 aa, Homo sapiens
MCPDPQGPGLLPGSGLCQQPACSQLRWRAWHSGACTAPAPRSRGMTVSQPAPKDGRHCQVTGCDLPRTSYLSFKGDISGQSFRDGGGKDSSPLLISFFYLFLLAPKLPGSHFLLLEFNQILPTPAPS

SEQ ID NO: 874964 - protein, 127 aa, Homo sapiens; identical to SEQ ID NO: 874963

SEQ ID NO: 874965 - protein, 139 aa, Homo sapiens
RRAGMGVEGGGGKRKSGLLWVLGLSQGWGRGTDGPYLGPFPYTCPYSWSASQWSSQSPPDPHPGTLPHVLSVGGRTSENTIDLALRGSQLNEADAVYLQRGGEPVSTCLHMQDPLFWGKTITPTCLIIDMSQESSQMGY

SEQ ID NO: 874966 - protein, 69 aa, Homo sapiens
WAVRSHLHLMDSVARVEVRVPGRVPRIGFRVYSSHGGSEWAELGLESGIRIVVLSPRYWDGSWESMLWF

SEQ ID NO: 874967 - protein, 104 aa, Homo sapiens
HHHHHHSHYYITITIIITIITITTVIIIAIITTTIITTIITIRITIIINIIIVAAVIHEIPQCTKYFPVFYSFGQYFLYPSDVPWTIMGLGKSVTQLNNQRYNV

SEQ ID NO: 874968 - protein, 75 aa, Homo sapiens
MAALSRLASFRVQLSSASSLFGKVVMRIKLVAAMAGRASTMKSWMLLILWLWLNFCTSLPPSASRIWMFVVVSDS

SEQ ID NO: 874969 - protein, 46 aa, Homo sapiens
ARKLIGDPNLEFVAMPALAPPEVVMDPALAAQYEHDLEVAQTTALP

SEQ ID NO: 874970 - protein, 106 aa, Homo sapiens
MPAALSVAGLLSLWGLVLFFPGPQRCLYALSVVGRSLCGGRSLCGGSAPCLFLCTSSSLNYAHLGRTRSSDAGRGSLHVRPALGLHVDNQLHTSSLMAILLGFGFY

SEQ ID NO: 874971 - protein, 86 aa, Homo sapiens
VLLLPSPPWDLDFASASVSIASSTSDTLSVKQQPGIGWPFCTLLPDPALAGSPTLPLGPGSSLSHDRPQAPLLSPRPLWKRFTSSS

SEQ ID NO: 874972 - protein, 71 aa, Homo sapiens
MALEEELGEGTGRGEGLQGVGDRKARLHTIALCRATVVLLNILATAAWLPKLTKRRTDCEVNFVPRAGKCG

SEQ ID NO: 874973 - protein, 106 aa, Homo sapiens [sequence omitted]

SEQ ID NO: 874974 - protein, 101 aa, Homo sapiens
MCRENNSKLYLNVQRGNNTRILSQTEMSRLISVSGNKGLQACVYSLFSAPSCAPVKGLLDRKCYSLGSKDRTSWGLSVLEHFTVSLRILRSNQKQGYRARN

SEQ ID NO: 874975 - protein, 103 aa, Homo sapiens
ELGPLMTEFPMNRSSQEHFSQLWLPWRPLSSFFAQLCLCRHAAALGSEALCSCTTEKQCQESQQCHESPQCLASKVPRFWEPWKGPWKIISPIQSLHLPETLP

SEQ ID NO: 874976 - protein, 209 aa, Homo sapiens
DNNTARTSKKTLALTAGGFHWHEGFPAPVPDPAAAEMLMPKKNRIAIYELLFKEGVMVAKKDVHMPKHPELADKNVPNLHKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874977 - protein, 230 aa, Homo sapiens
KDGPPTALVHLIVVSTTGLYPWKSRSLVSECSCWGRPTRKCAGLVPNSARADPAAAEMLMPKKNRIAIYELLFKEGVMVAKKDVHMPKHPELADKNVPNLHKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874978 - protein, 574 aa, Homo sapiens
MDQQYARVLVDSFLGEVDLYIPGGGGLIPGGGMPTGVPRAEGSPIGGPVGGLIPGSEAPSLTVDIGSGGTAVVTVGKSSKMLPHTDHRMRRILQDGRVFIGTFKAFDKHMNMIPCDCDEFRKMKLKNGSNQHVKKSGFRAPPLLKKLAGGATLTAIAQSLVTRPGHTRPHRDKKRNVLAKTLTGGEGENGCLCQIARHERTPAGPPQVHQPTRKSQRGLAGKDLSLQPPLQEEPRDPRIPDKEAGGVPCCDPETACSLTLHFHETLSLPLLQQKPSAGGERVGSVETGSDPATLGSCAHAAPPPFPAGLHLAGQPTGLTVASVPGVVHGGLGQPEQWDMLPSYPAPPATNTNWNVLSHLQTSHPLGFGAQRSGCPGERRERRRLRESTDMSQTEIKQSHTAPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874979 - protein, 235 aa, Homo sapiens
EITASALQPGRQSETVSKHGAGETGYVHANEMKVGPLLHAKINSKHIKDLYIRMKTSCPAPAPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874980 - protein, 204 aa, Homo sapiens
AGGGSTPARKRRSTAHAPSFPAPVPDPAAAEMLMPKKNRIAIYELLFKEGVMVAKKDVHMPKHPELADKNVPNLHKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874981 - protein, 209 aa, Homo sapiens; identical to SEQ ID NO: 874976

SEQ ID NO: 874982 - protein, 173 aa, Homo sapiens
MLMPKKNRIAIYELLFKEGVMVAKKDVHMPKHPELADKNVPNLHKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874983 - protein, 173 aa, Homo sapiens; identical to SEQ ID NO: 874982

SEQ ID NO: 874984 - protein, 188 aa, Homo sapiens
FAAASTTEGSFPAPVPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874985 - protein, 235 aa, Homo sapiens; identical to SEQ ID NO: 874979

SEQ ID NO: 874986 - protein, 201 aa, Homo sapiens
KDRFPQRLVHLIVVSTTGLYSMEEPLVGLGMQLLGPTHPQMRRPRAEFGTSKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874987 - protein, 181 aa, Homo sapiens
TRGSTHASPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874988 - protein, 181 aa, Homo sapiens; identical to SEQ ID NO: 874987

SEQ ID NO: 874989 - protein, 181 aa, Homo sapiens; identical to SEQ ID NO: 874987

SEQ ID NO: 874990 - protein, 181 aa, Homo sapiens; identical to SEQ ID NO: 874987

SEQ ID NO: 874991 - protein, 102 aa, Homo sapiens
MSFVQGGMAVDGRSRKRFLLLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874992 - protein, 173 aa, Homo sapiens; identical to SEQ ID NO: 874982

SEQ ID NO: 874993 - protein, 137 aa, Homo sapiens
MAIRFFLGKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874994 - protein, 164 aa, Homo sapiens
MPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874995 - protein, 173 aa, Homo sapiens; identical to SEQ ID NO: 874982

SEQ ID NO: 874996 - protein, 230 aa, Homo sapiens; identical to SEQ ID NO: 874977

SEQ ID NO: 874997 - protein, 181 aa, Homo sapiens; identical to SEQ ID NO: 874987

SEQ ID NO: 874998 - protein, 166 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 874999 - protein, 146 aa, Homo sapiens
MVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 875000 - protein, 181 aa, Homo sapiens; identical to SEQ ID NO: 874987

SEQ ID NO: 875001 - protein, 181 aa, Homo sapiens; identical to SEQ ID NO: 874987

SEQ ID NO: 875002 - protein, 166 aa, Homo sapiens; identical to SEQ ID NO: 874998

SEQ ID NO: 875003 - protein, 166 aa, Homo sapiens
SKGSRVDRLAHTRGVFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARTHREGKLTEIPTDGVLCHLVPTRKPRLGLGQQPNSSFRGGFGRGRGQPPQ

SEQ ID NO: 875004 - protein, 201 aa, Homo sapiens; identical to SEQ ID NO: 874986

SEQ ID NO: 875005 - protein, 169 aa, Homo sapiens
PRPRSRPVGNPGCRLRTEGRVKPPAGPGRGKVAPAPQLLPGPALWCWGPGFSSSGWRGHRAACLRAVWSSQSCRCGQLRARGREGALCPGQQLKEPRASQPLLGDQVLLRGSCPLPVQRVWALLPRGGGGAGEWNDPHRSYLYPGLSPRTDTPAPTWLQRPSPVRSPVC

SEQ ID NO: 875006 - protein, 101 aa, Homo sapiens
MPSVLFSQGTTSSSPARVRRAPSLSQALPIHSSARGSSDTSTCHSFSAVQVCTATPAQAGSSGPALLHTDLSHCLDCLAASLRPGIPALLSGGPPWCPAHL

SEQ ID NO: 875007 - protein, 160 aa, Homo sapiens [sequence omitted]

SEQ ID NO: 875008 - protein, 337 aa, Homo sapiens
AELAGPAPPWGRAGTHAGGRGDRSRAPMAGAAMAERGRVPPPAPAPSTEGLPRAFLQSLRTLFDILDDRRRGCVHLREIESRWQGTDARELPRGVLEGLRQVAPASGYLTFERFVAGLRTSLLSADGAPGTPRAPRPGPGISRRRRRSAWCSLRPTSRGRSWRGSPCPWACAPLWPVPAPPPAARSSCAPRLRRRPAPRSPSGSQSAALEPSSSADAGAVACRALEADSGDARRAPRARGERRRHTIASGVDCGLLKQMKELEQEKEVLLQGLEMMARGRDWYQQQLQRVQERQRRLGQSRASADFGAAGSPRPLGRLLPKVQEVARCLGELLAAAC

SEQ ID NO: 875009 - protein, 77 aa, Homo sapiens
FLEGSNFHTQWICHGNTEYVHKSPVGSGKVRNFENASHCLRTDAAPNSISPWNQHGCRNIFSLPVKDTPQQSGPFRS

SEQ ID NO: 875010 - protein, 118 aa, Homo sapiens
SDRWGPDICILNDPLGVVCGRWAFYGVRKFGTCGPFPAALLQERNGSPGLEPRALPPEAVWAGIEGGGARRCGTGWWTLAPAESGLEGRLLHTCRHSCPTLCPGGPHLKATLKFPVNT

SEQ ID NO: 875011 - protein, 124 aa, Homo sapiens
FWGSGWVAASAVRPRRGSGALSGVRGVDAARSRHTSTLLPRLFSVLLGIAHHPPPAFSGLVLHFLSSPLLRLLSLFGQTSLSEAPGFLGCSCEWHSRALPARPLRQPPPPVLGAALRSLKPCPL

SEQ ID NO: 875012 - protein, 138 aa, Homo sapiens
LPGSFRRPGYHLRHGDKSRDGVQGFPRLRRFLTWRDCRLVGTTQASGSLSVVVNRPSSWQSRLPKPHVLLIRDKLFLERSSLRAAADLYCLEEHFHSARKNTIKLTQGNNHGFSRLGASVWNRLGFFMLVGNLKQLLI

SEQ ID NO: 875013 - protein, 138 aa, Homo sapiens; identical to SEQ ID NO: 875012

SEQ ID NO: 875014 - protein, 123 aa, Homo sapiens
MEVYLSSHLLAFHQGHRPISEWFHSHGIWVDLLGEDQAWSNGPDVNLSCHWVHTSASSIHSTLQVWGVHVTVPTVSHNILQCTQVDQNYQEGSGQSRSVKGTETEWQKKRSGLHEASSPGGVV

SEQ ID NO: 875015 - protein, 44 aa, Homo sapiens
LVLDILPPLGHLHDSTLGWTALNAQKFGQVFPNWSLLKLINKTT

SEQ ID NO: 875016 - protein, 74 aa, Homo sapiens
GTQAPILLLCHATPAFPRLLMTQDGCCSTSHHIDVSTSSNEERVMQSQLPPVRTLTKHMCTIPHLYPIVWGFVT

SEQ ID NO: 875017 - protein, 113 aa, Homo sapiens
FCYQIKTNTFLGKERLYSQGSLQQEEGEYCNRENHPTTRATSISKTREKKISFYGEGSTKLERYQYGDRKITMKCFTQGQLILRRVVCWVRRRIDQNSRAWKRKRNLTDIRSS

SEQ ID NO: 875018 - protein, 1178 aa, Homo sapiens
WLPCGSSVVPATPGSPPSRFWLLPAMALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 875019 - protein, 1178 aa, Homo sapiens; identical to SEQ ID NO: 875018

SEQ ID NO: 875020 - protein, 1185 aa, Homo sapiens
ADSDGAVHHGGLPKLSQKVGVRGQALLGVARTREVLGEGDLGAVPYDSLVQPDGHQEHQADGEAPLPQVADLILMLHDPTGILRGREVEIFSGDPMAGDHHVDSIFHRQLQLEFGFVGSGHVVLTGHIGLEEQFVSKGSLRVYINVILKVTSEFSGKMGWFMLLLLLFKAPDTSVEEADSQARRQDRCERWFWSCGHLPVGQVKREEEGDLCPVGVLTIISHSHCHVELPGPTHHEAVQAHETEGDAEVILADVVIATILLKGKQGCEESLSILRQHCRRFPKADNGVPTREKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 875021 - protein, 634 aa, Homo sapiens
ADSDGAVHHGGLPKLSQKVGVRGQALLGVARTREVLGEGDLGAVPYDSLVQPDGHQEHQADGEAPLPQVADLILMLHDPTGILRGREVEIFSGDPMAGDHHVDSIFHRQLQLEFGFVGSGHVVLTGHIGLEEQFVSKGSLRVYINVILKVTSEFSGKMGWFMLLLLLFKAPDTSVEEADSQARRQDRCERWFWSCGHLPVGQVKREEEGDLCPVGVLTIISHSHCHVELPGPTHHEAVQAHETEGDAEVILADVVIATILLKGKQGCEESLSILRQHCRRFPKADNGVPTREKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQVRPGHCPCHDSSLFVDLSPNSVCPQLPAPGLK

SEQ ID NO: 875022 - protein, 139 aa, Homo sapiens
LVSPLYTKERLPSHSTFWLSFGRPPWLEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 875023 - protein, 1101 aa, Homo sapiens
MIELGTDYAPRRQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 875024 - protein, 265 aa, Homo sapiens
MIELGTDYAPRRQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGNAALRLMLLWRVSMWIHPPFNLQILLKSK

SEQ ID NO: 875025 - protein, 105 aa, Homo sapiens
SKAACAKYLFRIIPLTTKMLSLLEAHPALVFLKRHTGLGGQCGFETCQPAECKLISKDNSAVSQHGGNAWRQYHREVLTSTSEEKDWSPERKRKERRRHSKRSRV

SEQ ID NO: 875026 - protein, 238 aa, Homo sapiens
TSLVRGWCQSAEGSWTHAPFLCMVCVLVLAAAAGAVAVFLILRIWVVLRSMDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 875027 - protein, 89 aa, Homo sapiens
SFPPTNTTPHLLKVLCNGPGTCVPICVSALLLGILGIKKVIIVYVESICRVETLSMSGKILFHLSDYFIVQWPALKEKYPKSVYLGRIV

SEQ ID NO: 875028 - protein, 137 aa, Homo sapiens
TLNINIFQIFKEKRRFDYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 875029 - protein, 125 aa, Homo sapiens
MGSTSYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 875030 - protein, 111 aa, Homo sapiens
MTAPCVLVALKTFQWDKMWRWKTVILMILMLCRPRVLCNGPGTCVPICVSALLLGILGIKKVIIVYVESICRVETLSMSGKILFHLSDYFIVQWPALKEKYPKSVYLGRIV

SEQ ID NO: 875031 - protein, 92 aa, Homo sapiens
SNWHNQMVASGYRNGPVLCNGPGTCVPICVSALLLGILGIKKVIIVYVESICRVETLSMSGKILFHLSDYFIVQWPALKEKYPKSVYLGRIV

SEQ ID NO: 875032 - protein, 90 aa, Homo sapiens
SLGPPGRGEAERSLVLCNGPGTCVPICVSALLLGILGIKKVIIVYVESICRVETLSMSGKILFHLSDYFIVQWPALKEKYPKSVYLGRIV

SEQ ID NO: 875033 - protein, 137 aa, Homo sapiens; identical to SEQ ID NO: 875028

SEQ ID NO: 875034 - protein, 89 aa, Homo sapiens; identical to SEQ ID NO: 875027

SEQ ID NO: 875035 - protein, 238 aa, Homo sapiens; identical to SEQ ID NO: 875026

SEQ ID NO: 875036 - protein, 238 aa, Homo sapiens; identical to SEQ ID NO: 875026

SEQ ID NO: 875037 - protein, 238 aa, Homo sapiens; identical to SEQ ID NO: 875026

SEQ ID NO: 875038 - protein, 141 aa, Homo sapiens
PVSNMIHVVTSHYRQTRQRSLYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 875039 - protein, 177 aa, Homo sapiens
TSLVRGWCQSAEGSWTHAPFLCMVCVLVLAAAAGAVAVFLILRIWVVLRSMDVTPRESLSILVVAGSGGHTTEILRLLGSLSNAYSPRHYVIADTDEMSANKINSFELDRADRDPSNMSVDLDSICFLLVLYQILHSPNSKKPGGSAVLALHRFHHLALHVALLSPNSQGEARFGVV

SEQ ID NO: 875040 - protein, 139 aa, Homo sapiens
QVSNEGLQSVKGSGGGLRCYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 875041 - protein, 178 aa, Homo sapiens
TSLVRGWCQSAEGSWTHAPFLCMVCVLVLAAAAGAVAVFLILRIWVVLRSMDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVHRAVREEHTCLSDEC

SEQ ID NO: 875042 - protein, 94 aa, Homo sapiens
ITDVPLRQHHDSSCNLVLVLCNGPGTCVPICVSALLLGILGIKKVIIVYVESICRVETLSMSGKILFHLSDYFIVQWPALKEKYPKSVYLGRIV

SEQ ID NO: 875043 - protein, 91 aa, Homo sapiens
HSAFPPRPRRMYVARVLCNGPGTCVPICVSALLLGILGIKKVIIVYVESICRVETLSMSGKILFHLSDYFIVQWPALKEKYPKSVYLGRIV

SEQ ID NO: 875044 - protein, 178 aa, Homo sapiens; identical to SEQ ID NO: 875041

SEQ ID NO: 875045 - protein, 134 aa, Homo sapiens
TSLVRGWCQSAEGSWTHAPFLCMVCVLVLAAAAGAVAVFLILRIWVVLRSMDVTPRESLSILVVAGSGGHTTEILRLLGSLSNAYSPRHYVIADTDEMSANKINSFELDRADRDPSNMRRGLTVCPGWGAVVQS

SEQ ID NO: 875046 - protein, 238 aa, Homo sapiens; identical to SEQ ID NO: 875026

SEQ ID NO: 875047 - protein, 139 aa, Homo sapiens; identical to SEQ ID NO: 875040

SEQ ID NO: 875048 - protein, 89 aa, Homo sapiens; identical to SEQ ID NO: 875027

SEQ ID NO: 875049 - protein, 95 aa, Homo sapiens
GAPPGRGLVFERSVLAKFRVLCNGPGTCVPICVSALLLGILGIKKVIIVYVESICRVETLSMSGKILFHLSDYFIVQWPALKEKYPKSVYLGRIV

SEQ ID NO: 875050 - protein, 95 aa, Homo sapiens
SASIITFIRKREEGFIVTNVLCNGPGTCVPICVSALLLGILGIKKVIIVYVESICRVETLSMSGKILFHLSDYFIVQWPALKEKYPKSVYLGRIV

SEQ ID NO: 875051 - protein, 90 aa, Homo sapiens
GRELSLGALGGCRTVLCNGPGTCVPICVSALLLGILGIKKVIIVYVESICRVETLSMSGKILFHLSDYFIVQWPALKEKYPKSVYLGRIV

SEQ ID NO: 875052 - protein, 92 aa, Homo sapiens
HPRIPLPTRLNIKNTSVLCNGPGTCVPICVSALLLGILGIKKVIIVYVESICRVETLSMSGKILFHLSDYFIVQWPALKEKYPKSVYLGRIV

SEQ ID NO: 875053 - protein, 238 aa, Homo sapiens; identical to SEQ ID NO: 875026

SEQ ID NO: 875054 - protein, 134 aa, Homo sapiens; identical to SEQ ID NO: 875045

SEQ ID NO: 875055 - protein, 137 aa, Homo sapiens; identical to SEQ ID NO: 875028

SEQ ID NO: 875056 - protein, 178 aa, Homo sapiens; identical to SEQ ID NO: 875041

SEQ ID NO: 875057 - protein, 94 aa, Homo sapiens
YPTPGEEKPPDGYPYRTIVLCNGPGTCVPICVSALLLGILGIKKVIIVYVESICRVETLSMSGKILFHLSDYFIVQWPALKEKYPKSVYLGRIV

SEQ ID NO: 875058 - protein, 100 aa, Homo sapiens
GVRLISYTEATGQTSLRGYSNGPLVLCNGPGTCVPICVSALLLGILGIKKVIIVYVESICRVETLSMSGKILFHLSDYFIVQWPALKEKYPKSVYLGRIV

SEQ ID NO: 875059 - protein, 90 aa, Homo sapiens
FLPSSIHLYPLLCLVLCNGPGTCVPICVSALLLGILGIKKVIIVYVESICRVETLSMSGKILFHLSDYFIVQWPALKEKYPKSVYLGRIV

SEQ ID NO: 875060 - protein, 156 aa, Homo sapiens
SATSTNSNNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEVAVGDIVKVVNGQYLPADVVLLSSSEPQQCVMLKQLICLWSKLY

SEQ ID NO: 875061 - protein, 140 aa, Homo sapiens
LSKSWVLFVGEAVSHYQSPGRVWLLFVGEVVSHYEDPVYCLLGKLYLTIRVLGIVCWRSCISLSESWQSVVIVCWEAVSHYPSPGYCLLGKPYLTIRVLGIVCWEAISHYPSPGYYLLGSRISLSESWQSVVIVCWEAIS

SEQ ID NO: 875062 - protein, 141 aa, Homo sapiens
FNFNCGKKGRYKPTALRFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQVILIDLL

SEQ ID NO: 875063 - protein, 228 aa, Homo sapiens
LRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQV

SEQ ID NO: 875064 - protein, 115 aa, Homo sapiens
RPSSEARSHIPAVGTTKADFYKLKSRTFRRRGGAPRAGEGAQASPRPHSATPGAAPGEGWQTSRGRQVGSAGPMGAGTGVRGHSRAFCSRRPPPLPRGLLHTTRRRQLHTGWRGP

SEQ ID NO: 875065 - protein, 126 aa, Homo sapiens
QALSGIDSEYTMLLCLGGQGATLIWTEPAQYLWVIWLPAGVTGATRLCSVCLSSFITLAQACFHGDPEVQERTSLIAQALFQASACSMGASISLAKASHVATSRCEELGAFCNAPGRHRHLMISDL

SEQ ID NO: 875066 - protein, 253 aa, Homo sapiens [sequence omitted]

SEQ ID NO: 875067 - protein, 164 aa, Homo sapiens
QAGTGLGVLDVLRNIETPKREAEERKSHTQTPREEMTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGQDLVPKQAIQVQEADEAGWGGSGG

SEQ ID NO: 875068 - protein, 104 aa, Homo sapiens
MAVGKNKRLTKGGKKGAKKKVVDPFSKKDRYDVKAPAMFNIRNMGKTLVTRTQGTKMASDGLKGRVLEVSLADLQNDEVAFRKFKLITEDVQGKNLTNFHGMDL

SEQ ID NO: 875069 - protein, 119 aa, Homo sapiens
LSPRVRTAAFSSSFPEALQNLLAFQEGLHLSLKLFLTTFPTTLTELLHMTSPSSLGHVSRQVGLPWTEVEWSWKSGHSTASGTSVGPKVCRPCYCRHEWAWRIPGFLVKGALGRTGEEW

SEQ ID NO: 875070 - protein, 94 aa, Homo sapiens
APHPLPGTQHFEPRIMGNSRQVHTVLSPSLQGLGEVGCSQLPPAWPGISWTPAGVAAQPLVGFFFGGTDSRPVTQAEIAPLHSSLGDRVRRHLE

SEQ ID NO: 875071 - protein, 101 aa, Homo sapiens
AAICHVFAIDPGLLASLTHVTTLGMAGECSCPHFTGVVIKAQRMEVMDQSRLPSGGSIGSQTEARLHSAVPPPTTNARGPLCPRVPGCDYEALGEGLACLR

SEQ ID NO: 875072 - protein, 129 aa, Homo sapiens
VSRTKSYECQLSFDLAYMISNLQVYKTYLEPPPSSVTQAGVQWHHLSSLQPPPPRFKRFSCLSLLSNWDYRCSPPYRDVFSIFLERHGFTMLARLLSNSLPHDPPTSASQSAGITGVSHGAQPIFSFHP

SEQ ID NO: 875073 - protein, 106 aa, Homo sapiens
CFSHFTVKESEDEKDEGTFPKSHSPQASAKMWTPLPCLVPISGERKAPLGRGGDWPVAASGISPVSARVKNLPCCGFQTLSVQLPIWTLVKVVVNNTQSISLSRAQ

SEQ ID NO: 875074 - protein, 70 aa, Homo sapiens
PVGHTPLVAPLTSWHLAVKPQNLASPGMELHHLHDVVEWTPLTASPTTRRATTKLIIDDGAPLPAHSLWS

SEQ ID NO: 875075 - protein, 33 aa, Homo sapiens
PNPKPPQALGLLQGPCAAPGPALNTCWHLKPNV

SEQ ID NO: 875076 - protein, 38 aa, Homo sapiens
MGLMKMHMDVNSRDVKVLPWQQKHERPSQPQGGRVDGR

SEQ ID NO: 875077 - protein, 104 aa, Homo sapiens
MVPRLLKSRVTCRPVLSLLIFFVCFVLFETGSHSVALTGVQHSPRLPHYACWYPKSGRAKAAGGQHVSTAPSVCTPGWAVTVPQLGPMLLQDQSRCQQQGEASQ

SEQ ID NO: 875078 - protein, 110 aa, Homo sapiens
NPPQLSCPDARPGGVGEAAPALRSRSARQRAVMSTASAAVPGSPKTRRPRKPQPGSSRQGRGGEDARVPGVPHSVCLSRGDREWTHGGAVDPRGGGRRGEGRELWSQVSI

SEQ ID NO: 875079 - protein, 109 aa, Homo sapiens
LGRGWTPVFWGKLNALDHHYTAGGSSHQSSLPASSSPFVYLAVAICQAHLQCSAVGKELWIVTWRTRATLCCDLQISPIIFGHRAFMSLLIVPCHAGGRAGLPSAPRCS

SEQ ID NO: 875080 - protein, 139 aa, Homo sapiens
MGGGAQSAQAWFFSPSELLSSSDLPDSASHSAGITSVSHCAWPITCFNNNKKQQNLAEGWKVTKQLSFKPRFKNFVSFLLSPQFLDIALRQTADVLSFVVNYCLGMGIKTAFPFASYAPMPYAHLFTWMLVKLIPCPLI

SEQ ID NO: 875081 - protein, 71 aa, Homo sapiens
LFHCSEEETGHFGFSDLEPGSETYGLWAQISQLPVSVNKVYWSRGTLICFWMVRGCFCAVTVEASIAGGVL

SEQ ID NO: 875082 - protein, 76 aa, Homo sapiens
NLEDPPPSTGMLGSGNGLSNAWRQDNRRVFKEQCVLRPSYSRGGQEEGRKSILGRRLETGGSKRSTEPLTALREGT

SEQ ID NO: 875083 - protein, 67 aa, Homo sapiens
CSQSGEVSRQETAKSSFLPSQPLLRSGRTASTTRGHQPTLDGSKCAHVVREPQHRVAAPSSTVIEHE

SEQ ID NO: 875084 - protein, 146 aa, Homo sapiens
MSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATL

SEQ ID NO: 875085 - protein, 40 aa, Homo sapiens
MVLSLSSYSAENVLTPKRTEQIMLQVSEKKCEGMLNPQHL

SEQ ID NO: 875086 - protein, 129 aa, Homo sapiens
CLCGERHLWLSSGRAGPHACCCTQALSSLGCRRFWKLRRGCWTPPPATPEKDSQAAISEAHGQGRRQREENPGSWSEAGFCPRRVSGSDFCHVCWTHVHSHCEPQACWQHVEQNPRSCRSSLPSSFETA

SEQ ID NO: 875087 - protein, 280 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGFFDLGTSLECPEGWSSSAVPTVSCGRRRVWCPKGPPDVPGRLGHRA

SEQ ID NO: 875088 - protein, 195 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGHLLV

SEQ ID NO: 875089 - protein, 214 aa, Homo sapiens
MARYEAGFYFGRGFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPMANATHQTEMRTHITT

SEQ ID NO: 875090 - protein, 236 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875091 - protein, 236 aa, Homo sapiens; identical to SEQ ID NO: 875090

SEQ ID NO: 875092 - protein, 236 aa, Homo sapiens; identical to SEQ ID NO: 875090

SEQ ID NO: 875093 - protein, 236 aa, Homo sapiens; identical to SEQ ID NO: 875090

SEQ ID NO: 875094 - protein, 236 aa, Homo sapiens; identical to SEQ ID NO: 875090

SEQ ID NO: 875095 - protein, 236 aa, Homo sapiens; identical to SEQ ID NO: 875090

SEQ ID NO: 875096 - protein, 245 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGPPPPGMRPPRP

SEQ ID NO: 875097 - protein, 243 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGFFDLGTSLE

SEQ ID NO: 875098 - protein, 280 aa, Homo sapiens; identical to SEQ ID NO: 875087

SEQ ID NO: 875099 - protein, 243 aa, Homo sapiens; identical to SEQ ID NO: 875097

SEQ ID NO: 875100 - protein, 238 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPWGMALRNAALPGIAGPSRMGIQA

SEQ ID NO: 875101 - protein, 306 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPWKRTPWDALGMRLLPGCSFLTWPEYGRPARGRTEAVTQTGTRTGRARTGGQRDHTGMAQANWSEQATTETNEKENKKKRNNETSRKRAGRR

SEQ ID NO: 875102 - protein, 157 aa, Homo sapiens
MTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875103 - protein, 243 aa, Homo sapiens
PVRPGQSSWLVHANPGAITIDAMTWAAMLPLITDEVHPATADLLPQLWPELSSVMESIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875104 - protein, 195 aa, Homo sapiens; identical to SEQ ID NO: 875088

SEQ ID NO: 875105 - protein, 170 aa, Homo sapiens
MIFQSILLIFRSLGIRAYLFIFQTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875106 - protein, 415 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDIFRWSLALSPGWSAVARSWLIATSASRVQVILLPQPPEYAGITDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPMGDCAQYGNAGSYPWMPWAPSPGMGHNAYTPFGPLIPAVTEGDISYDPGRPMKRGQIRPLKKREAQHQRGATEYHQEGTEREADTVRYKRGPQEEKKHGARPGLKNERQHEGTSETPPGRQDTTTRTATMRMEELDEQRPTERNDDRRHGLAQPGT

SEQ ID NO: 875107 - protein, 240 aa, Homo sapiens
MTVGKSSKMLQHIDYRMRCILQDGRIFIGTFKAFDKHMNLILCDCDEFRKIKAIEESSNTRGMKGVQMNADVPRLLAACVQKAENFWSSTDRSDGDSPSSDRYLDIAVEDSSIAWYGCPVRPHVAVASEVALAGRRAYIHHAGGLPQCASVDSPAWTLTWAIVLCGLERGQSSNTAAWTPNIATEVASMQASCYTCMNTMLTLFACGAPNLEYAFLDLCEWYRTPELWRRRSSATFRGND

SEQ ID NO: 875108 - protein, 236 aa, Homo sapiens; identical to SEQ ID NO: 875090

SEQ ID NO: 875109 - protein, 300 aa, Homo sapiens
PQASMRIAGSGGILDPHTTGTTKGWEILGHMLSHLHSWIDVCPAPMRRISLVPFERSLTLHCVFEIPPAAWVALQVSTRESPRPHRNSTTKLKWRNDHMEFSGSGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPWACPLGMRLSPGMRGSLDLGRVEFSRGWVIFRPFPDRWYRAVGLNVVS

SEQ ID NO: 875110 - protein, 236 aa, Homo sapiens; identical to SEQ ID NO: 875090

SEQ ID NO: 875111 - protein, 236 aa, Homo sapiens; identical to SEQ ID NO: 875090

SEQ ID NO: 875112 - protein, 236 aa, Homo sapiens; identical to SEQ ID NO: 875090

SEQ ID NO: 875113 - protein, 236 aa, Homo sapiens; identical to SEQ ID NO: 875090

SEQ ID NO: 875114 - protein, 245 aa, Homo sapiens; identical to SEQ ID NO: 875096

SEQ ID NO: 875115 - protein, 245 aa, Homo sapiens; identical to SEQ ID NO: 875096

SEQ ID NO: 875116 - protein, 239 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGKCLQW

SEQ ID NO: 875117 - protein, 225 aa, Homo sapiens
LFRGGHKPRFFFQPRGEPHNFFGTKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875118 - protein, 263 aa, Homo sapiens
MVIIVTYDMHGAVNSCLDVCTIIDTPRLRDASTCTESDSHYYGCASMSSVYLGLIVKLEMLQYLMLQMIDDVITTQESEPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875119 - protein, 227 aa, Homo sapiens
CIYTKTGYLATISKRIHTRRLNRSGFHSFESSSAKFHSKCLYYKQQRGDLSKPGLACSGLVLLRGENLVSMTVEGPPPKDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875120 - protein, 188 aa, Homo sapiens
MESRSVARLECSGTILAYCNLCLPGSSDSPASASRVAGITDTGIARVPLAGAAGGPGIGRAAGRGIPAGVPMPQAPAGLAGPVRGVGGPSQQVMTPQGRGTVCSRCSCCHSQYCRGSNPVPTWPWGSSPDLWAEEHPLQGMMGPPPGMRPPNGGPPMGGSPLERGTPNGGICPLRECGLLPLGCEGLL

SEQ ID NO: 875121 - protein, 88 aa, Homo sapiens
MTVGKSSKMLQHIDYRMRCILQDGRIFIGTFKAFDKHMNLILCDCDEFRKIKPKNSKQAEREEKRVLSGAAAYPDLKALQSTCCKVWT

SEQ ID NO: 875122 - protein, 109 aa, Homo sapiens
PTFTYPRLTRNPHIVLDSLGNGSSNIGFFFICLHQKFLSISFSRLRFNFHHHLGSFLGGEDELRLKSCQFSLHNRYLRSCKVEFLQACQVAVPHHSHLLPLAIQERLEG

SEQ ID NO: 875123 - protein, 142 aa, Homo sapiens
EVPPQRPPPGLQPLCSAREARLAGAGVTVGRGPPVFLISAGGVGAEAAAVRTWPGVGAAPWTPRLRRNPAWLRGPDLRLRLTPAAGDAVRTPSQCAEDTVLPSAWLPPTRSRRSPRPTPTRRRPGDAETQTARDSGSWEQRP

SEQ ID NO: 875124 - protein, 111 aa, Homo sapiens
PPTHVCRGCVNNYICWLPSHWPLLLDPTRGCFYPGRPRRTIYGNELQSHQPIFLVQPNLQNTGAQNLSLASDFKDPPNDTVSGFSRSFMDEAGSLKGNQGSASSLLKKLFT

SEQ ID NO: 875125 - protein, 107 aa, Homo sapiens
SRRENTRRGAGGSGSGPGPGPGEAMASRDSNHAGESFLGSDGDEEATRELETEEESEGEEDETAAESEEEPDSRLSDQDEEGKIKQEYIISDPSFSMVTSPKGRYVG

SEQ ID NO: 875126 - protein, 115 aa, Homo sapiens
MIVKVTRLSAFCVPLSVEHMTCICSFTLMVFMVETLGCSHFPEKEIEVQEGLGNLSMVTWPFLPGCKSCTVNLPALTPFCGKCQMDSSGIRGLENWREKGGPSWPLEERSPGLLP

SEQ ID NO: 875127 - protein, 145 aa, Homo sapiens
SAGIIGVSHHAWLFLFFEMESHSVSQAGVQWHDLSSSNLCLPGSSDACASGSQVAEITGVCHHTRLIFLFLVEVGALPCWPEWSETPDLKRSARLSLPKCWDYRCEPLRLRRVVNLLAKLTHIKRVRGTPARTSFQPAFQTDVTK

SEQ ID NO: 875128 - protein, 149 aa, Homo sapiens
QDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNA

SEQ ID NO: 875129 - protein, 86 aa, Homo sapiens
AAALCTAGGWAASPPSAQQIITFISDNPRVVTTKNVSNSWTDVLWGTRLPQVENPCSGCLSLKLLMTNQSPIQHHLKLFIGNKRKK

SEQ ID NO: 875130 - protein, 116 aa, Homo sapiens
HLRSEGFPSLVLQRAGQCPGSGTPSVPFLATMGRPCVLTTLSHPLTQRLSRNGTWWDGDLEHATGEVELLSLFFPRFSPESESRDGSRGTFWPLPARAQQMESNVSVSPKNVYPHC

SEQ ID NO: 875131 - protein, 55 aa, Homo sapiens
APLLRSHVMAAHSLQRLPPPATRPAARVLPVKSPHRFTFHVKLAKPLQRSFFNTA

SEQ ID NO: 875132 - protein, 87 aa, Homo sapiens
MVLSISRSCMYSRLTSASARPGAVSLPPTAALFQALRDLEPTPTGAPGSTACSHLGQSWPEIEDDPSTIPTVDGIALGVQEASLWNE

SEQ ID NO: 875133 - protein, 143 aa, Homo sapiens [sequence omitted]

SEQ ID NO: 875134 - protein, 101 aa, Homo sapiens
PGHWNLKCPREEVSGLKGALGTGVSPLPLRPADPHPAWAVVAECPRPVASPLWAGFPAEGGRGSLLPVVASAWGRACGCTISIGVILPQPCCDRHGRQVCL

SEQ ID NO: 875135 - protein, 494 aa, Homo sapiens
MGQPREFWHLRSQVPVPTCHLLTVQPWCLLPHPTPAGGRERRHSASSLLAALCLRKAVLRPHPAVLPGVGGCVVLSSGRMKAPLRGGLALGTGPAPTKLQLLHDWQSEPGPSGWQQGPSPPLFPAGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 875136 - protein, 494 aa, Homo sapiens; identical to SEQ ID NO: 875135

SEQ ID NO: 875137 - protein, 139 aa, Homo sapiens
LLDGTSPIHSPKKKLKGTLDSSSHSFPPLRKAWQIYFLNTATIYSLLSIPCVSSTVQVIFNYFHSLQKPPPEPSSPACCKALTLSHPLINFCNCPHHHLELLCVLMAVSPPKTMLLREGEHLVPGFSPLCPPRTAFMVL

SEQ ID NO: 875138 - protein, 133 aa, Homo sapiens
AAQLCGSQTWMCQWPRQEVNPQPRASRCPRPSLVQEVRSAEPTMAEMHKGDPMVPLFKSSANPHPTQRRSQVLTAACHPCLTRPPLGSVLHTLLSLSVSSPTREEILHIYPGGFKPIFAIQIVTGMNRYKESF

SEQ ID NO: 875139 - protein, 121 aa, Homo sapiens
MTDRNRDKKSTSPSNSDTEMKSEQLPPCVNPGNPVFSCMLDPKTLQTATSLSKPQMIMYKTNSSHYGEFLPIPQFFPCNYTPKEQVFSSHIRATGFYQNNTLNTAPDRTRTLDFPNIQHTL

SEQ ID NO: 875140 - protein, 121 aa, Homo sapiens; identical to SEQ ID NO: 875139

SEQ ID NO: 875141 - protein, 136 aa, Homo sapiens
GVCDFKGSLQRQEKRPPNRLCDKKSTSPSNSDTEMKSEQLPPCVNPGNPVFSCMLDPKTLQTATSLSKPQMIMYKTNSSHYGEFLPIPQFFPCNYTPKEQVFSSHIRATGFYQNNTLNTAPDRTRTLDFPNIQHTL

SEQ ID NO: 875142 - protein, 115 aa, Homo sapiens
CSPPRLSARVWSVPALDPPLTPAPSHHLCPPAGPWERSRTLTHRKARVAKDGFSLHRFRHAYFLKAHNTCKGAGREKQKNYLKPRKRIQNYAKSHKKVIWLCMVAHACNPKTLGG

SEQ ID NO: 875143 - protein, 79 aa, Homo sapiens
TASTGGLVSAPLPGPLLGLREDADKGQGKREVAVAELLRRFGSCSSDYSDRQGRIGGGQFPALRSCLRSERQVPLCCLG

SEQ ID NO: 875144 - protein, 95 aa, Homo sapiens
FAARKELLDFSSYVSPERTTHHPWTAKPRKEALTKPTTINIMEALAIDPGYSKSMGVDQASIFLKAPQVILKYIHIRLPGEKAQNGDSCEIILER

SEQ ID NO: 875145 - protein, 67 aa, Homo sapiens
SRSRLSLHTSLQAEGVDSGLGQPRKGLPQCSRGLKGSSSAAKVGAQAEESPRASAGCEDCQHAVTSQ

SEQ ID NO: 875146 - protein, 117 aa, Homo sapiens
PRDPSDWFSGITGEGGRWVLAGWSPFQPHGGRGRGWGRGLGLCTCLSTSLLCIPPSISNQGRMRKEFVGITLLLHALASQKFPSGGPWSDGHCHLDLKKDTWSLGWEPGSLSLTLWP

SEQ ID NO: 875147 - protein, 229 aa, Homo sapiens
MTLVRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGVVCVGGDGSASEVAHALLLRAQKNAGMETDRILTPVRAQLPLGLIPAGSTNVLAHSLHGVPHVITATLH

SEQ ID NO: 875148 - protein, 61 aa, Homo sapiens
TNQTHKDWKQEDKLPPGLPNGDVLSGLDILDERGESRPFQASKGPVSHQTHALRPSQGGRI

SEQ ID NO: 875149 - protein, 105 aa, Homo sapiens
LHSLAFSPDKPTLSSGSLQLPGAGAGPAGTARREGSLRVSAWLVEVETKASWVLAFPGVQIFLRRKCSKKVHRVVDERPRSGYRVHRSGDSAPESQKSPLKNLPM

SEQ ID NO: 875150 - protein, 155 aa, Homo sapiens
VARQRGSSLPSQLGGQTEALLTFQTGRQPERGAPHLPDGAAARQRHSSFARWWGRRAEGHFTSQTGQQPGRGGTRIFIAALFTIAKTWSQSKCQSMIDWIKKMWHIYTMEHYAAIKKHDFMSFAGTWMKLETIILSKLTQEQKTKHHMFSLISES

SEQ ID NO: 875151 - protein, 110 aa, Homo sapiens
MEAFHGWKEKLQRSFTWIGREVAQRHVMSGKGRVQRLWMEGKVVPKLMDSGPRPERRKREGGSPGSLASYGFFTKCSVFCLRRSGYETRGQSATRGVRSVPSSSWGWAGD

SEQ ID NO: 875152 - protein, 68 aa, Homo sapiens
GEASPCSTLYYELAIEGSLHMHILGPLDSLDDLSKDHFSGVVSPEEKDIPEETEETKTYGTGVNSALK

SEQ ID NO: 875153 - protein, 183 aa, Homo sapiens
ALESCETRVVAALEVPGAVPSRPFRAYSVFHTVEQLSYLMAEDKHCGHIQADPAQVGDNAVVEGLEPFLSQDLQPQSRVFCICAFQAPHPGLDPVQWSVSQDTGCACNGSEGPSDQRVHGLAGVVPSVPAMQGGQEKKRMAWFQPCFSAGAVRPRWVPLFPHNLPNPGGRLLCTGRLGRSGGG

SEQ ID NO: 875154 - protein, 189 aa, Homo sapiens
GSLFLYGTEKVRLTYLRNQLAEKDEFDIPDLTDNSRRQLFRTKSKRRFFFRVSEEQQKQQRREMLKDPFVRSKLISPPTNFNHLVHVGPANGRPGARDKSPAPEEKGRVARGSGPQRPHSFSEALRRPASMGSEGLGGDADPMKRKPWTSLSSESVSCPQGSLSPATSLMQVSERPRSLPLSPELESSP

SEQ ID NO: 875155 - protein, 133 aa, Homo sapiens
KSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLGK

SEQ ID NO: 875156 - protein, 152 aa, Homo sapiens
TGPDSLVCCSLSYVHAHIQTEPNSLWPPGSLLVHQRAKHTPTQGPLNLLFPPTATFCSHISAWLPSFWSLLNHHLEGEQSGKSTPQHPSVPNPLGFPVFFMKQTTLNIIHLSLISSPLECKLHEGRGFAILTVVSPVPESVPGMVNRHLLGE

SEQ ID NO: 875157 - protein, 148 aa, Homo sapiens [sequence omitted]

SEQ ID NO: 875158 - protein, 132 aa, Homo sapiens
AELTGTCHHAQLIFVILVEMRFLHVGQADLEHLTSGDLPASASKSAGITRVSHCALTTFRHLNLQFPLPHLVSSKTSTWYTPSSTTLSQIAAPSLSCSTPSYSSHVWVIVLHINVFMCQCPVSCTERHSPCS

SEQ ID NO: 875159 - protein, 111 aa, Homo sapiens
MDSVLIHVLIDGLVACVAQLIRIADELLQFILQVQEVPYVEENGRAEETEADAPLPEEPSLPDLPDLSDLDSILTPREDEDLIFDIDQAMLDMDNLYEDTVSGINDDLTGD

SEQ ID NO: 875160 - protein, 119 aa, Homo sapiens
AGLPPAAAHARISLLLPLQPRRCTGFIGLKSSCSSLASAPQHRLLPLRGRPAVVLLTTSHDRGPEVTFPLAMNNPIVTPHGCAHRKLLMGRRGTVQAGFSSPYHSAGCVGGQESHYVCK

SEQ ID NO: 875161 - protein, 105 aa, Homo sapiens
MLPLKYFSHLFPFLPFRFVSGPHYSYLIISPLQIHATHNYWVSSTAILLKNFPLLPNFYKVQIPYPDWVQWLMPIIPALWEAKAGGLRGQEIETIVANMVKPYLY

SEQ ID NO: 875162 - protein, 105 aa, Homo sapiens; identical to SEQ ID NO: 875161

SEQ ID NO: 875163 - protein, 79 aa, Homo sapiens
MHTHTHTHTHTHRAVAEAYAYVHTHIITHFLPVLQTHIITHFPPVLQTHIITHFPPVLQTHVITHFPPVLQTHIIMHFP

SEQ ID NO: 875164 - protein, 323 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIVLINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNMRNKDNHCMEVIRLKVLVSID

SEQ ID NO: 875165 - protein, 275 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNMRNKDNHCMEVIRLKVLVSID

SEQ ID NO: 875166 - protein, 180 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 875167 - protein, 81 aa, Homo sapiens
SQPPCDAGSMAVPMLQMRKLRHSGVNIACPRPHSQEVTDQNCSHAQFPGDGSASHRSCIYMSSGGGACVCPPQILDPSWPR

SEQ ID NO: 875168 - protein, 88 aa, Homo sapiens
MCVLRTHLDAQFCPLPEEEDTAPSRAVLGSRPSPGGAGWKLSKSSFHGGRPLGTGDRTASHTQYIWMCSEIYALAPEMDSGVLATALA

SEQ ID NO: 875169 - protein, 68 aa, Homo sapiens
ERVLRGDGTSETGRTGWRRLYEQEGKEDGARRGEAAEEEQGGVWREWSLQKGAAETGAGRLKKGALER

SEQ ID NO: 875170 - protein, 109 aa, Homo sapiens
PPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSK

SEQ ID NO: 875171 - protein, 127 aa, Homo sapiens
ATDAAEHRRALRETALHKRQKGPRRQEKERRKNKRAEAAGNCLPPDAWGLKPRRQSLRPRSREGQCGGTQSDPSFCLVSGAPNNSVSHTADAQQVSDASVAATGLSWISLGVCIVPPSMARQCLLVC

SEQ ID NO: 875172 - protein, 44 aa, Homo sapiens
MTDATHQAEADKGIITCHNPSAHFYFRRVFVSYNRFPHAKSEFI

SEQ ID NO: 875173 - protein, 107 aa, Homo sapiens
MGLRDQPAQGWPVPPPSDKCTQESSMGVSSAPGLEGSCHCGWGLTSWTSVGNRRLQHAASERPEPGPGALSSRHPGCGLWAASPSCGFQVPGYIGALLCPGSFREKE

SEQ ID NO: 875174 - protein, 120 aa, Homo sapiens
MFQIRLSSLRKMTNPFQAWFKLKLKLCLRFSSREVLIVSWLFLVYWLRNCALEGRGVLRMGQLMEGEWKTLVAQENMSTSVHHCNSGLIIIFSASVSTNETMPLNHILCCLQYFPPLRHL

SEQ ID NO: 875175 - protein, 123 aa, Homo sapiens
QETASTEEGTVQIQEGAVATGEDPTSVAIASIQSAATFPDPNVKYVFRTENGGQVTYRVIQVSEGQLDGQTEGTGAISGYPATQSMTQAVIQGAFTSDDAVDTEGTAAETHYTYLPSHVELIK

SEQ ID NO: 875176 - protein, 120 aa, Homo sapiens; identical to SEQ ID NO: 875174

SEQ ID NO: 875177 - protein, 111 aa, Homo sapiens
HISLWKHSRLYRGQAWSLPSHQFCVELPSLKMVNCFLLAFILSGSLTFRTLFSVSNLFISQDPRLSYLHVHCKCNVNESSDKIFLYFVISKEFLYRRTQWGLACTSTIVSE

SEQ ID NO: 875178 - protein, 115 aa, Homo sapiens
AILPYGTGYARTPVRSQWSSFHPVLLRLRQSETSCLGPNRRRVARREDRASFPRRGRGTEQGGLGIGLSKAVQSFREGQKSLKREVKPFLSVGLLASYLALLSCPPGSHFHGLFG

SEQ ID NO: 875179 - protein, 43 aa, Homo sapiens
TCCAGLPSRGNFEWVLSSRNEVDPQTTGGQGQTDPVALKMYVL

SEQ ID NO: 875180 - protein, 102 aa, Homo sapiens
GREAGPGRRGGAWRKGRAAGSALGTKGTGGRNAPSRSRSDARVDQGLSSGERFPTGFVHSPSPAAPALRAPVSSSGSWKQILPEVSRTHESVLISFSFGKKY

SEQ ID NO: 875181 - protein, 57 aa, Homo sapiens
MWAAVPLPAFLPRWGSGEDLAALAHLVLPAGPERRRASLLAFAEDAPPSRARRRSAE

SEQ ID NO: 875182 - protein, 103 aa, Homo sapiens
LKANRRNPLFQAVNMKQRVDVRDAPKTGHSVNDKTETRIHILNAQSSARPTKPFGFCKSTEFPQNKTQTITNRCFRWSVFILVFIQCSFLLLLQKQKVAKRVF

SEQ ID NO: 875183 - protein, 55 aa, Homo sapiens
LEDPPARGNTGLLISSTQLEKANTAQSPLYSTPVSQQKCFGRAQWLTPVIPALWE

SEQ ID NO: 875184 - protein, 73 aa, Homo sapiens
QNSFLLVGIKEGFVDLVALELALEGEAGFGPVAIWAGEDMSLACLTVSEDLRFLELRMCDAEEVWKGKKQNCK

SEQ ID NO: 875185 - protein, 129 aa, Homo sapiens
HVFTVCACACFVCACMFSYCVYLRLFCVCVHVCSYHVCMRMCVTVCVRALVRAHVCLVTVCLRLFCVCAHMCLVPCVCVCAWACVFSCCVRVLVLCVCTHVCLVTVCACACFVCVHACLVTACACACFV

SEQ ID NO: 875186 - protein, 140 aa, Homo sapiens
MKNNTRFKNQYSITTIYIVLTLYWCYKQSRDDLASIQEDVPRLYANTVPFYIRNLSISDIGIGRRPVARGPPSQGPPPDLQTLGFDPLSEEAVEQLEGVLRLLLGASVQCEHRELFIRHIQGLSLEVQSELAAAIQEVLR

SEQ ID NO: 875187 - protein, 144 aa, Homo sapiens
MTNSSNKAKEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDCLRSFKERIFTGQRK

SEQ ID NO: 875188 - protein, 138 aa, Homo sapiens
PLATEHTDSPHPVNSGTVPPLLSHAPFPHLGSIHMPPVVSSQRLEGPSSALQSCFFMELPLLPYFSLYIPAFLEPLNSTLCLHQVLVPLPALWLETLQVTRWATEASLPSCPSLVTVHTACHQCLKPVASCTFVWLSG

SEQ ID NO: 875189 - protein, 101 aa, Homo sapiens
GPWQQASGACSCLFSCPANRRNLPPIISLSACLSRLVCIHCCVYNKSAGPCWKLGRFNGELSKHLQHPFECNWKYWCLRSYTSLNHLLLTRFWEIQHQGAS

SEQ ID NO: 875190 - protein, 361 aa, Homo sapiens
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVWSCGFRTALVVGGIATVYE

SEQ ID NO: 875191 - protein, 361 aa, Homo sapiens; identical to SEQ ID NO: 875190

SEQ ID NO: 875192 - protein, 129 aa, Homo sapiens
MPLGFCPSTDGRTLQQSHKYTNTTHHTIHIARTHTHYTHHIHITPHTRTHTHTHTPHLLKPPGGWPVACGVARGPCVGPGQEGISSGVETRPRTCMPLQWDQGGGGGSGKGPSTSRGHRARLEEVGQNI

SEQ ID NO: 875193 - protein, 129 aa, Homo sapiens; identical to SEQ ID NO: 875192

SEQ ID NO: 875194 - protein, 123 aa, Homo sapiens
FSVRRLRGDINKLKIEHTCRLHRRDAQRCHLRLEERGELADLFCDSPLASSFSLSTPLKLIGVTHFCVPSITQPICLSFKQKAFKHISEPHFHLSGVLKGGSGDCKIRGIWSESSLASASSNR

SEQ ID NO: 875195 - protein, 116 aa, Homo sapiens
FSVRRLRGDINKLKIEHTCRLHRRDAQRCHLRLEERGELADLFCDSPLASSFSLSTPLKLIGVTHFCVPSITQPICLSFKQKAFKHISEPLKGGSGDCKIRGIWSESSLASASSNR

SEQ ID NO: 875196 - protein, 176 aa, Homo sapiens [sequence omitted]

SEQ ID NO: 875197 - protein, 111 aa, Homo sapiens
GSLNAQKVCLMQSLNWQPDGLIQHGWSVKKVYIRIRNCPTRSSMKIGLGVFHLLLQEYWSHKMCGRHIEIQYGFYFHFGRHACPPQIDTRLGRLGFSLILENKLMATVAPF

SEQ ID NO: 875198 - protein, 42 aa, Homo sapiens
RKDPCKVAGTLITSHQPPPGACTLSPRESAPGEVSATANRQE

SEQ ID NO: 875199 - protein, 128 aa, Homo sapiens
CLRTVQLLIEHFSPRKHQGSGVAIYFTLFLLSCLGSLNFDLGGNQRMARVSSSSCQIKCSPLAQRRGLNSLPVNLISVSAPLFHGDPFSPTLFNHLSWPLLSWPCSNSYNPEDRQVLLPFSYYLVTPS

SEQ ID NO: 875200 - protein, 69 aa, Homo sapiens
GFGKGGHNVDKAPVYCIRRLPDLSSSSSSPVRPKAEPPTLTSQGRCQRVWMRRACLSGLSATSSLPLCP

SEQ ID NO: 875201 - protein, 76 aa, Homo sapiens
VVFVGKIDEGQRILRKASQREMTVLMSSSLIRGKQKGQRRKQEMESWKQEDVRRESQVQGCRCLQELEKARRRMLS

SEQ ID NO: 875202 - protein, 170 aa, Homo sapiens
RTSPSPPKGMPNPAEKRSSPAKERERGNVNPRRKRQSKEEASIQETNAKPSKECKAKPSGYMPAKPLTRVQHARASRYRAAKPLRACGVRLQAVTGQSDGYAGAACACKPLQASQAAAARATCACGVHISGGVSVRGTDTGRCVQPTCLSLGARNVTDSPVFPANFVGVS

SEQ ID NO: 875203 - protein, 34 aa, Homo sapiens
MATKARRRFWKIRYKSERKKGRKEETHKEHQLCQ

SEQ ID NO: 875204 - protein, 134 aa, Homo sapiens
MKSSRPLKMFITTFNLDIICSNYHHFSFIQHHERAQLAVVFEELQEVAAEQSRILILITLLSRSQRTKLIKALCLEIKGNRTSAKFFLSIHTLKTCKINDTQNGREILITRVKTSRYFFPVHINGLYCGIYMKG

SEQ ID NO: 875205 - protein, 134 aa, Homo sapiens; identical to SEQ ID NO: 875204

SEQ ID NO: 875206 - protein, 137 aa, Homo sapiens [sequence omitted]

SEQ ID NO: 875207 - protein, 169 aa, Homo sapiens
MLVSGQLQTMMKAMVIRAFFYTSCQTCQDWLTRIRLSIMRVGLLAGQPAVTVRHGFDLLTEMKTTSLSQGNELEITIMMVVEALCELHCPEAIQGIAVWSSSIVGKNLLWINSVAQQAEGRFEKASVEYQEHLCAMTGVDCCISSFDKLVLTLANAGCNSASPKHCLNG

SEQ ID NO: 875208 - protein, 355 aa, Homo sapiens
VRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKNFGSSHVMQVIYTDDAGRPQTAYLQCKCVNELNQWLSVLRKVSINNTGLLGSYHPGIFCGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 875209 - protein, 274 aa, Homo sapiens
VRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKNFGSSHVMQVIYTDDAGRPQTAYLQCKCVNELNQWLSVLRKVSINNTGLLGSYHPGIFCGDKWSCCHQKEKTGGRGGLGPGLCIRPLRDRASG

SEQ ID NO: 875210 - protein, 380 aa, Homo sapiens
STRWARLGRVGLGWGEGRAKSGGEPGALGRTRRLCPGEGQGRSLRGGGCQEPWSGGLQPALFRTLQNVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKNFGSSHVMQVIYTDDAGRPQTAYLQCKCDELSLTKWLAVLPEGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 875211 - protein, 157 aa, Homo sapiens
ASEPRSLSAPALIPSFLKHRQGLSLKSLYAIKGSSSRRNAIVLKLSPLEFSSNNQKRLMTRAGKKTKSHHHTQIEFSSTFLRAAPRDCLGDFICIIRPPLFTVKFYLSLPTNCHHLPQSSEELRPSQVVCSLGPCISPEKHLLPIRITYIPHVSSPL

SEQ ID NO: 875212 - protein, 241 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQQFGPLAQLSPQERLSRETALQQKQVSLEAWLQREAQTLQQYRVELAEKHQKTLQLLRK

SEQ ID NO: 875213 - protein, 102 aa, Homo sapiens
MWLYPICSFYYSQSDLTKKLNLNMQILYPQLCNDFCFRISDLFKITYEIIFPCLTLYPYLSYVYVPGELLTKHQLCFSAMTIDLIFTPFSLQDLSLLRFLCL

SEQ ID NO: 875214 - protein, 114 aa, Homo sapiens
PAVASLDGKRLYITTSLYSAWDKQFYPDLIREGSVMLQVDVDTVKGGAEVEPQHGETPSLCCLLIIQSWHWQLCTKNTQISWVWWYRPITPTSQEAEVGGSPEPREVKAAMSCD

SEQ ID NO: 875215 - protein, 43 aa, Homo sapiens
MLCVGCKGSGSVISPECPLQMPGSGRSAVKGRREAAMHQLFFG

SEQ ID NO: 875216 - protein, 49 aa, Homo sapiens
IGPTEASGKMQDCMEFKRSARITKTDFLGSQNGFKIHSEEPGAPLLLRA

SEQ ID NO: 875217 - protein, 30 aa, Homo sapiens
PRSSSRCPTGSCAVSTSHASPPRGPTPSSR

SEQ ID NO: 875218 - protein, 73 aa, Homo sapiens
REQALSPTGHLAHTASTDSPQPFPDLAGVAGAAGLMAPILAPGGELIHRSGPFTLREKIVACIPNPRPRLWVS

SEQ ID NO: 875219 - protein, 75 aa, Homo sapiens
QAERIVLPGSLCAGYPQGHKDACQVCTQPPQPPESPPCAQHPPSLNSRTQDIPTQAQDPGLQPRGTTPGVWNPEN

SEQ ID NO: 875220 - protein, 327 aa, Homo sapiens
QDFRLRWDFWTEQWSAEAPATCALQGAQTRVQALGSATLTQPSLEDRMRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVSF

SEQ ID NO: 875221 - protein, 118 aa, Homo sapiens
TLQREAPGWPDGAGLDCVEGAYLPGLCCAVLCWPDCIGYGRLCWAVGLGWLHWLRPGSLVPGVILGSAWCDQRSHQSKTFILEAGMASVAMLTDLSIHVVESDSSELVVAAVTLTEWN

SEQ ID NO: 875222 - protein, 110 aa, Homo sapiens
MASFLEACETTNPSIKKRPLIRETSRLISGDTFRISPKQVKVRSSVVIEDKSTRDPEYIYSQPYVCRCTQQLRRDSDHRERAMMTMAVLSKRKGGNVGKSKRDQIVTVSV

SEQ ID NO: 875223 - protein, 61 aa, Homo sapiens
MPYSVDLVHAQIHVAEGRSLPDLGLRQENIRINGCAIQCRVTTEDPARSFQPDTGRIEVGG

SEQ ID NO: 875224 - protein, 115 aa, Homo sapiens
VKQTKVGTRQVPRTVTLWGGLESDRPRLEPGRYHGRSHCGGAGVRQTKVGTRQVPRTVTLWGGWSQTDQGWNPAGTTDGHTVGGLESDRPRLEPGRYHGRQVPAAHPSGRNDGQQ

SEQ ID NO: 875225 - protein, 108 aa, Homo sapiens
MRRPNRATGGLTPPWPHKRSPGKGDAGVSEHSPTPPPFVGVCTEHNCPAPQKGLWEEHQKVALWGNWPSSNTTSPTTAESRNNRPGGDRVSCTAGQEQGQASVQLQRE

SEQ ID NO: 875226 - protein, 114 aa, Homo sapiens
QQACCSQAQHGQLLLRAFSAYPGWVAASLWCAHGSPECLVDREPSAGRTAAPCPRQPPGAWSPGTSRAVLSFSPLSLQPLTQGMPDPKLDELLDLSDPRQNGRKVPNFQDWPGD

SEQ ID NO: 875227 - protein, 99 aa, Homo sapiens
CDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYK

SEQ ID NO: 875228 - protein, 84 aa, Homo sapiens
MSSHSAPYLEKTICPTLSCRVGFLVLTGPGGVSTLHHHHSVSTTAALEALMSASVSPPAFSFLSKITLAMCRNPGFYFQVSDAL

SEQ ID NO: 875229 - protein, 124 aa, Homo sapiens
LPSPGEWQPPEVVVLVLGDARPKSPGRSGLGGGRRSGPSLEQGAPGVTCPSSHPGVTVEGRGWAAEGTALANNILVGGVQRHQGGLTRCASGVAQTLAVVLPSEEVCRWVRGYDLVVFTFFLAA

SEQ ID NO: 875230 - protein, 68 aa, Homo sapiens
AMSFNWTHSLETDFQMLPLQDYWRNASCAGDGIVRSGTQVFAAKERALKEEIQLVHVTMNQRSGTQNY

SEQ ID NO: 875231 - protein, 74 aa, Homo sapiens
DVGDGDGIGDVGDGGGDGVSGNKDGRHRGVDKSIALDPQGSDSDSVSILAYCMMWATTTTTMTIITIIRVTTAP

SEQ ID NO: 875232 - protein, 153 aa, Homo sapiens
NKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPY

SEQ ID NO: 875233 - protein, 721 aa, Homo sapiens
GTRAEPTEPTEPTEEPTEEPQRPNGQTPSSREGAREAATMCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEVGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 875234 - protein, 350 aa, Homo sapiens
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 875235 - protein, 350 aa, Homo sapiens; identical to SEQ ID NO: 875234

SEQ ID NO: 875236 - protein, 284 aa, Homo sapiens
RFLRRRAWRGPRRTTSVSLGRRIVLVAGQTWRRAGGLCGPQEIGGRPARFPTPSCFGLGFSFTLSEEESMARASAKHFRQPRAEDRLSSWPDLEESGRSLRASGDRWPPGPFPACPDRCVQTHQRKAVAAGPPVPPRPRCGMAAPPGVPASPGSREWRPLRGGVLPGRTPDRWRGQGRARGSPVPFSARCCHSRVPSTLPFTRSLLSASPWAGGLLTSLPVALEKNPVPRLRPYPQSSAGSGPWGGGCTAEGGWLWARLPAACTSSSTHRLLPGGNFAWGSFFG

SEQ ID NO: 875237 - protein, 350 aa, Homo sapiens; identical to SEQ ID NO: 875234

SEQ ID NO: 875238 - protein, 350 aa, Homo sapiens; identical to SEQ ID NO: 875234

SEQ ID NO: 875239 - protein, 128 aa, Homo sapiens
ELGTREIIVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDDL

SEQ ID NO: 875240 - protein, 95 aa, Homo sapiens
RPLGAPPTPEALRRRFLEPRLSRLPDGRQRRRRRRRPAVRPACRRLALTMMKKKKFKFKVDFELEELSSVPFVNGVLFCKMRLLDGGSFTAESSR

SEQ ID NO: 875241 - protein, 98 aa, Homo sapiens
MRTQRPAPRLGSSLREGGDQGAAAPQGRVGRGLCRPLRHSAGAQRAGEPLVDTRQSRFSAGSLLQPLPQRPRRRLLGSLAFALFVNGVSGVQAPSQFV

SEQ ID NO: 875242 - protein, 237 aa, Homo sapiens
MEPDSVIEDKTIELMNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIECNWRCGTNTTWQRIQCRSENSKGGLLFTVR

SEQ ID NO: 875243 - protein, 239 aa, Homo sapiens
MCALSCLQSMPSVRCLQNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIEFYLAVWNDTTWQRIQCRSENSKGGLLFTVR

SEQ ID NO: 875244 - protein, 271 aa, Homo sapiens
MEPDSVIEDKTIELMCSVPRSLWLGCANLVESMCALSCLQSMPSVRCLQNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIECNWRCGTNTTWQRIQCRSENSKGGLLFTVR

SEQ ID NO: 875245 - protein, 250 aa, Homo sapiens
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIECNWRCGTNTTWQRIQCRSENSKGGLLFTVR

SEQ ID NO: 875246 - protein, 187 aa, Homo sapiens
MEPDSVIEDKTIELMISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIEF

SEQ ID NO: 875247 - protein, 152 aa, Homo sapiens
MCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIECNWRCGTNTTWQRIQCRSENSKGGLLFTVR

SEQ ID NO: 875248 - protein, 36 aa, Homo sapiens
IGGKGRTSTFRVLPSGGPLQQTLLCHQGFEPIVSHQ

SEQ ID NO: 875249 - protein, 69 aa, Homo sapiens
IALLNPVEASPPQEPRGHALRIHPTHTGVPDSGPHWTLLQWLPNLSPTPGRLLSSIHSLGSGPSSHYRH

SEQ ID NO: 875250 - protein, 80 aa, Homo sapiens
FRVLYLGTTDPRPATLSQTLLPCDLQVLGDAQPRCQGTLEAVKWLCESSSSQILPKGKIVTYHWNQHLGYCDICLRLTPR

SEQ ID NO: 875251 - protein, 131 aa, Homo sapiens [sequence omitted]

SEQ ID NO: 875252 - protein, 72 aa, Homo sapiens
KGQRPYPVCRARLVMVAQLLWHVQIAPWPQCDSYRGRAEAPGPEDDSSGLMDTVPRLCRLSCFPVCWERELP

SEQ ID NO: 875253 - protein, 57 aa, Homo sapiens
MVNDAEKFAEEDKKLKERIDTRNELESYAYSLKNQIGDIEKLGGKLSSEDKETMETG

SEQ ID NO: 875254 - protein, 112 aa, Homo sapiens
MCSFKSPPEQPYKYHCYHHFTGDDLRLNESPEFTQTGRNRARIQIQTFDIRAYTLFFFFFFFEMESRSVTGQNRRVRILGPRKPRPPGLKEFSGYKPPEHLGPRAPTTKAWQ

SEQ ID NO: 875255 - protein, 160 aa, Homo sapiens
MSRKPWTRRAAGARPRAPPARLTPQSRRPKVGSDAQRRAPQGGIRAGRPRRSEPRPGAQLRAPVLPPPAKSHPLCLLLQHRACLGSRSAQLGVSPTSAAEPPASAPSFRGFEPPVERKGHEVSKVKWIFGGGWCGSQWAGRGKPGSHRPEQGPGWPPPLA

SEQ ID NO: 875256 - protein, 111 aa, Homo sapiens
MAPRPPKAAAVGAHTRVGEIPAVLHRAASPGPWRAHPSRLGCPAAHGQALLAQPGTGRPSQRTGRLAPAGRARPAARSGQASAARRISPEPAASRARGGRVWGMRAGRAAA

SEQ ID NO: 875257 - protein, 118 aa, Homo sapiens [sequence omitted]

SEQ ID NO: 875258 - protein, 36 aa, Homo sapiens
MSTWFPKRGPGDDTRPGPPLPTDTVTVLMDQTRGLA

SEQ ID NO: 875259 - protein, 136 aa, Homo sapiens
GAIIINNNFKSESGFSKKKIDASGKKSRFINKINSQDYSLIHIRLDSVMLFSVCIFPSWKSLIVSIPWNCGIDFTISNFHGLAGPQWSKDTDLALWRCRVITKEQISQAQWLMPVIPTLWEAEVGGLLEPKSSRLQ

SEQ ID NO: 875260 - protein, 78 aa, Homo sapiens
PGSASLAALRGLARALQALEPAEASGSHKLVMSWFEQNGLNSPQRAPLTPGCTDATPICPQPTAAPRDGECESSGRVV

SEQ ID NO: 875261 - protein, 251 aa, Homo sapiens
LFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDV

SEQ ID NO: 875262 - protein, 108 aa, Homo sapiens
GYLELPDLGQPYRSAVYSLEEQYLGLALDVDRIKKDQEEEEDQGPPCPRLSRELLEAVEPEVLQDSLDRCYSTPSSCLEQPDSCLPYGSSFYALEEKHVGFSLDVGGE

SEQ ID NO: 875263 - protein, 69 aa, Homo sapiens
NSSNGSLTNKCQRPYVTILFQSLYHPFKPASFILPKNHDAPNSQTIIQAQHILYAVLVTNTLQPNVKPS

SEQ ID NO: 875264 - protein, 172 aa, Homo sapiens
VPVQMLVTSASVLTLDSQAVTTQLLQPPGLDLLEGRDAGNKAGSGSSLCEFSIPGGRGRVGPQGQQGLELGAREQSLLGCMQGACEFWGGDRAWSRYKGLWHHCATSFCESTFTDHLGCTQHLADHWAFWEYTIRRERQWTQTVTMPCAHFAASLGPRRMDAELGVRTPSFA

SEQ ID NO: 875265 - protein, 123 aa, Homo sapiens [sequence omitted]

SEQ ID NO: 875266 - protein, 159 aa, Homo sapiens
LSFLLVNNPGHCQARNLRVPLDSLTASCPNPHHPCLDASNSLLTGPSLTVVLGQSILFPGPDRAFPKYRTAHVTSCFTTFRAPQRLQDRAQTSYDGHPRAVHVAGLHLTCNTPIPPLGRPLLKDCPLYSIHVCGSKEPVFSVLCPLRTFLSLSLLLAWC

SEQ ID NO: 875267 - protein, 60 aa, Homo sapiens
MVCAKTHLEFPAPPSQAYLHQVTFTHLTDIQTCLRCPAPNSQGLELFIEIPAIILDQVPE

SEQ ID NO: 875268 - protein, 68 aa, Homo sapiens
GSCGCSQCNCCKPCCCSSGCGSCCQSSCCNPCCCQSSCCVPVCCQSSCCKPCCCQSSCCVPVCCQCKI

SEQ ID NO: 875269 - protein, 87 aa, Homo sapiens
TPGGRSSDNAMIDLEVYLFILRVETSLDNIWTGFYQGKENVTGRQRNPMNWDLPKTCPSWLRQASGIQAAVCFPWMPTGPALCSHFT

SEQ ID NO: 875270 - protein, 90 aa, Homo sapiens
MGFMKPGHLAMPWAALFCQQLWRMGMLGTRVLSLVLFYKAYHFWVFVVAGAHWLVMTFWLVAQQSDIIDSTCHWRLFNLLVGAVYILCYL

SEQ ID NO: 875271 - protein, 122 aa, Homo sapiens [sequence omitted]

SEQ ID NO: 875272 - protein, 122 aa, Homo sapiens [sequence omitted]

SEQ ID NO: 875273 - protein, 128 aa, Homo sapiens [sequence omitted]

SEQ ID NO: 875274 - protein, 111 aa, Homo sapiens
MLDKYFHVFYTNVIFVICLNQIYFKRFLCRVFMPFSPSECADFLTWYYQLGQEVVSHDGFCQYGFVVLKPNETQNHLSSSCFREVVSKATYLSETGRSLTVVNHQRSYGEN

SEQ ID NO: 875275 - protein, 120 aa, Homo sapiens
AAASASLSPWTTRPSYVLSLALQCFFYGFPVLPPQGEFQLSLGGPAQTSPLPQGTPRFLALSRGSFLLPGWTKAMIAPGQDKLAHKLTINASDPVSAFFVCLEDIRVQAVQNPDPGHPMA

SEQ ID NO: 875276 - protein, 167 aa, Homo sapiens
MSREAGSCRVGTGARARSRKPKKPHYIPRPWGKPYNYKCFQCPFTCLEKSHLYNHMKYSLCKDSLSLLLDSPDWACRRGSTTPRPHAPTPDRPGESDPGRQPQGARPTGAAPAPDLVVADIHSLHCGGGPKSRAKGSPGPPPPVARATRKGPGPSGLLPESWKPGMG

SEQ ID NO: 875277 - protein, 46 aa, Homo sapiens
QHGLQGIGGGWLADGSEGRNRAWSSPSKGALMLDSVLLEDLIRTSC

SEQ ID NO: 875278 - protein, 118 aa, Homo sapiens
MECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDE

SEQ ID NO: 875279 - protein, 91 aa, Homo sapiens
VIPPRQDKRQTAELPWGYLPEIHISINPEGENVRDGAPRAAAHDENSNSLDWLQRKANGQEISCKRHEPKLAEQSHSNAPGSPDVRPQLPD

SEQ ID NO: 875280 - protein, 102 aa, Homo sapiens
MHLALPWSVAVGLRHHSPRPCYEPRTELVHFAMPQGSRYRHLPRLQGEEIEAQRREVACQDHRARVGPISSPGRVTPGALPPPRMSGWGRQEIRTVEQMVAQ

SEQ ID NO: 875281 - protein, 165 aa, Homo sapiens
RPLQPHLDRQACTLQAGCLRCLGPMNDGSLPVRSPGLSSGTGSEGGSWGHMTAASEGRAPRIQVSSWWQGTCPSKPSKGFRGPVRTGLIDARRFPLTAAAAGLKPAGPCTAPRTSSAEADMKSQHAGRLEPLCLQAAAPFVKIQREREGTKKYKTIFQIKRNVET

SEQ ID NO: 875282 - protein, 76 aa, Homo sapiens
MFASVHSCFLSIHMFYSDCWNPDPHSRPSFTNILDQLTTIEESGFFEMPKDSFHCLQDNWKHEIQEMFDQLRAKEK

SEQ ID NO: 875283 - protein, 1066 aa, Homo sapiens
PLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 875284 - protein, 125 aa, Homo sapiens
MDKRKSLINSRSSPPASPTIIPRLRAIQCETVSQISWGQNTQGHLSPALSSHRLVQACSIHNFCHLSSTMCIYMHICTQTLSPLPCLSPLTLLLPPLPFSHISAKGFVGTNGIFSGLQSNLETGV

SEQ ID NO: 875285 - protein, 52 aa, Homo sapiens
MEQNAAALPPECLLSVRSTPSTSPTSLHLITATYEMGASGTPTAIRTQNPFT

SEQ ID NO: 875286 - protein, 34 aa, Homo sapiens
MQSKPRHRGGLEVSKPGTPRPHRVGIVDHAFAAR

SEQ ID NO: 875287 - protein, 127 aa, Homo sapiens
LLPHASPQSPCRYLKVPGELLPKGLCTCCSLSLQYSSPCDHTAHAPTPFGSQLECHLLPMTFPNLSCKILPLPSSVSCFSCFVLENTNQHHLICNYSLEHILSQPREWKLHAGGDIICSVHAVAQQF

SEQ ID NO: 875288 - protein, 80 aa, Homo sapiens
ERDSVGVGPSEPGAGYNLVVHRFLSRSEKRNIRVGVTRFSRCCLRRCHAYNGKRQAVYTSSHCESSTLRRCRLEAWLQYA

SEQ ID NO: 875289 - protein, 260 aa, Homo sapiens
MLPWQFAQFILFTQIASLFPMYVVGYIEPSKFQKIIYMNMISVTLSFILMFGNSMYLSSSYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISCVLATNIYLRKQLLEHSELAFHTLQLLAFTALAILIMRLKMFLTLHMCVMASLICSRQMLSSQVPCLQWQASSCLHFIPL

SEQ ID NO: 875290 - protein, 305 aa, Homo sapiens
WTPPLHESFSYPFLVLQMYILTLILRTSSNDRRPFIALCLSNVAFMLPWQFAQFILFTQIASLFPMYVVGYIEPSKFQKIIYMNMISVTLSFILMFGNSMYLSSSYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISCVLATNIYLRKQLLEHSELAFHTLQLLAFTALAILIMRLKMFLTLHMCVMASLICSRQMLSSQVPCLQWQASSCLHFIPL

SEQ ID NO: 875291 - protein, 60 aa, Homo sapiens
MAWRTGQQLAGSYGQLLLLPCGNNLLGNLLEVPFHVQPIHSTRLIVRAPLQVVGALPYPG

SEQ ID NO: 875292 - protein, 37 aa, Homo sapiens
REREPGIVKAYMEGVWMIRTQGVEQESCGKGLDLESG

SEQ ID NO: 875293 - protein, 79 aa, Homo sapiens
EADSRGSPTVPGAFQRHLACLFEPVSPSTGQRLVDADDVEGVEPHPDMEAIFATAFYHVLIGTNSGSLQGFRGQLLKFI

SEQ ID NO: 875294 - protein, 126 aa, Homo sapiens
MQICEAFHTLKKTHTDWDLLCKASDAFQSVRDKRYTGCSHSHSKHHPAPLVLAPPTWKGARHIPTSCLPRMENSLGNTLRTQKATRPVKPFQPVFASKRNAILKSGNTPLLHVKIHKLDELNRGEQ

SEQ ID NO: 875295 - protein, 138 aa, Homo sapiens
MLLLHAPSSPGERQGRNPRDEPPVAPSRAPNGRDVLVQRQPPRSPPVLGRPPRSPRDGEGRHARPLYGEGRHARPLMGKAATLAPCRGKAATLAPCTGKAATLAPRWGRPPRSPPVWGRPPRSPPDGEGRPEKKKKKK

SEQ ID NO: 875296 - protein, 111 aa, Homo sapiens
MCSFTVIHSLHFFIQHSFTGHIFCAGDLAGHKEYRDGQNRVLSFQEISCFSELNFFIRIPNHRVNSALFHKQRCIYWYPWCHFPACDVSSLSGPIPDHTQPKRLLGVQWKV

SEQ ID NO: 875297 - protein, 142 aa, Homo sapiens
MIVYLENPFVSAQNLLKLISNFSNVSGYKINVQKSQAFLYTNNRQTESQIMSEFPFTIASETIKYLGIQLTRDVKDLFKENYKSLLNEIKEDTNKWKNIPCSWVGRINIMKMAILPKVIDRFNAIPIKIPMTFFTELEKRLL

SEQ ID NO: 875298 - protein, 76 aa, Homo sapiens
RSHAGSLTYPSLLCAWLALGKHGIQAGSTSRAQPARLSGQNEPSRCEQNSSRGAAGHRGFQLAKQHLKDPVTFWDE

SEQ ID NO: 875299 - protein, 98 aa, Homo sapiens
PPPPLPRGLNEQQGVTNSQVHLSSSQALPSTLYDLGRAEAREKNLTGSWSGPHGHPGDHQVKWSQGLLSTLGMGGDMSQHEWPEGEGQQPCPRQWEKH

SEQ ID NO: 875300 - protein, 43 aa, Homo sapiens
MFPPASWRPWGPGQSPKGVRWFWQVKPGEGRRKHFHIVNPSDE

SEQ ID NO: 875301 - protein, 148 aa, Homo sapiens
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQKPSASFTRGY

SEQ ID NO: 875302 - protein, 93 aa, Homo sapiens
RYQAHTTHQLGIQARATIDFSSTTLQEAKESGLTHLALNPDLRSYWSGPNIHFPINCQYKVNPRGTHLRLGFRAFRTEAIMLVSFNSTVQILG

SEQ ID NO: 875303 - protein, 78 aa, Homo sapiens
YVLTTKHTYAIYAHETPMEEGGEEKSPSKKKKKIQKKEEKAETLGLWCLRCLWGVECGPWTSVTFCEGAMASDESELC

SEQ ID NO: 875304 - protein, 123 aa, Homo sapiens
KEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 875305 - protein, 123 aa, Homo sapiens; identical to SEQ ID NO: 875304

SEQ ID NO: 875306 - protein, 111 aa, Homo sapiens
TGAANAVCTFSSLVFKQHWAVASSSPVGVKMTIMSTSIKGFMGGQHCSPPFLSSGPLLSLVALLALMHGIRATPSVTAIPNMPPTSGSSGPAPSTMVAMNCMCPFTLSTIK

SEQ ID NO: 875307 - protein, 207 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSHGSVPVLRAFGVTDEGFSVCCHIHGFAPYFYTPAPPGFGPEHMGDLQRELNLAISRDSRGGRELTGPAVLAVELCSRESMYGYHGHGPS

SEQ ID NO: 875308 - protein, 66 aa, Homo sapiens
CSRGSVGREYSMDLRTKSTGGAPTFNVTVTKTDKTLVLLMGKEGVHGGLINKKCYEMASHLRRSQY

SEQ ID NO: 875309 - protein, 254 aa, Homo sapiens
SLRGNQHCLLLDFWPPALGEDKCLLFEAAPLVVIVSAAGECCISRQVLLEKPAQRHPGSAAPGPVPIGNIPLGIPLKPWPHCAACLPAEGLTSHAESKEVHQHELRKLNFLCLQTCMHLKTAMPASHGQTSFLSRQILQSFIPLVPALPSSTPRQDSPHFWRLLLPPPYLIAIWLCPQHALKLFSLSDGGAPSSQMQWELFCPWLDSGCHPTEEIPYSVNHQPRVQARKYASGINIKSSISPDFRYFLNPSLPL

SEQ ID NO: 875310 - protein, 38 aa, Homo sapiens
MNTEWRTCSSSSSCTTFSTKLSSACSLSSTMLCLMIWG

SEQ ID NO: 875311 - protein, 118 aa, Homo sapiens
MRENISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 875312 - protein, 219 aa, Homo sapiens [sequence omitted]

SEQ ID NO: 875313 - protein, 32 aa, Homo sapiens
MSRSFLRPHQKQVLPCLLDSLQNHEPNKPLFF

SEQ ID NO: 875314 - protein, 196 aa, Homo sapiens
MLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELKWGRFNYHSIKRITEGADLICSTWRLEISQVTCM

SEQ ID NO: 875315 - protein, 129 aa, Homo sapiens
MAKSLRSKWKRKMRAEKRKMNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 875316 - protein, 31 aa, Homo sapiens
MVKEVGLALRTLLATVDKTIPLLPASTHREI

SEQ ID NO: 875317 - protein, 203 aa, Homo sapiens
MSHCARPLSSLEQSKKCSRRGRRFFQNNFSNYPQPANLRLWSEAGPSPLLILESQCVSPNLLPPQVAPNALLSHRGPGLGLVLGPGFLGQKAGCPQHTLSHRGAGLGLVLGAGFLGQAAGPLDTLHGRQGFFLQQVVFASLAVLALLCVLLLPESRSRGLPQSLQDADRLRRSPLLRGRPRQDHLPLLPPSNSYWAGHTPEQH

SEQ ID NO: 875318 - protein, 49 aa, Homo sapiens
FLLLPREFLLLLAGAQYLPGWTVLFLSVLGLLASRAVSALSSRKGSSRI

SEQ ID NO: 875319 - protein, 150 aa, Homo sapiens [sequence omitted]

SEQ ID NO: 875320 - protein, 126 aa, Homo sapiens
IWSLTLSRRLECSGTISAHCKVCLPGSRNSPTSASHVAGITSAHHQAQQIFVFLVEMALRHVGQADLGLLIPGDPPASASQSAGITGMSHCTWPGYLFCKVSVEVVCPSSSRLACLLADLKEFFIF

SEQ ID NO: 875321 - protein, 91 aa, Homo sapiens
KFLASSDLLASASRSAGIADVSHRIWPLLVAFSEFYVKALLKCPGGLGCPLIKEWGTKKLVALCVWLVNWWTHSEMNWLALSLGDPQCWRL

SEQ ID NO: 875322 - protein, 298 aa, Homo sapiens
NFLKRSYLKRLGDFLFLYQWGFPGTCPTQGPRPERPSGRTTPADIFPSRRHRLLRAPPFRLHREKPATAWSPGRVFKHQDGSNSGKEVPRPALGKRWGDQGKTRSAMAAQIPIVATTSTPGIVRNSKKRPASPSHNGSSGGGYGASKKKKASASSFAQGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 875323 - protein, 298 aa, Homo sapiens; identical to SEQ ID NO: 875322

SEQ ID NO: 875324 - protein, 303 aa, Homo sapiens
NFLKRSYLKRLGDFLFLYQWGFPGTCPTQGPRPERPSGRTTPADIFPSRRHRLLRAPPFRLHREKPATAWSPGRVFKHQDGSNSGKEVPRPALGKRWGDQGKTRSAMAAQIPIVATTSTPGIVRNSKKRPASPSHNGSSGGGYGASKKKKASASSFAQGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLEPPNCFPQRLHQLTFPLAMDEGSNFSRCSPTLVNFGFVFIMAILVGVK

SEQ ID NO: 875325 - protein, 215 aa, Homo sapiens
NFLKRSYLKRLGDFLFLYQWGFPGTCPTQGPRPERPSGRTTPADIFPSRRHRLLRAPPFRLHREKPATAWSPGRVFKHQDGSNSGKEVPRPALGKRWGDQGKTRSAMAAQIPIVATTSTPGIVRNSKKRPASPSHNGSSGGGYGASKKKKASASSFAQTSVLMLLHPLSQLRSILMFQVCLPTTQTPRANCGSAPLKSFPTFGGCPLTSSPATWP

SEQ ID NO: 875326 - protein, 201 aa, Homo sapiens
NFLKRSYLKRLGDFLFLYQWGFPGTCPTQGPRPERPSGRTTPADIFPSRRHRLLRAPPFRLHREKPATAWSPGRVFKHQDGSNSGKEVPRPALGKRWGDQGKTRSAMAAQIPIVATTSTPGIVRNSKKRPASPSHNGSSGGGYGASKKKKASASSFAQANYTDPQSKLRFSTIEEFSYIRRLPSDVVTGYLALRKATSIVP

SEQ ID NO: 875327 - protein, 151 aa, Homo sapiens
MIVRPPQPRGNGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 875328 - protein, 118 aa, Homo sapiens
PSIFEAADLWMGFLWGLFLLMLLLLLSVCLFLTVRPLFCRAAAICWGSNPYPTRLGPSRIWRYYQWRLQNSKDGCLLRPLGGSTDLMPAGTFLYKMSGNPWWVSVRRHGIRDLLKEAL

SEQ ID NO: 875329 - protein, 1640 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 875330 - protein, 1583 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 875331 - protein, 1165 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSSWRPLLRGGNVRGCQAAL

SEQ ID NO: 875332 - protein, 1685 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKVSRRCPWLQSWTIQVDGTHVPPVPLPSVPITSLAKCLDGSLNFVKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 875333 - protein, 103 aa, Homo sapiens [sequence omitted]

SEQ ID NO: 875334 - protein, 1679 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKEQCGSGGSDRSAACQRGRLLSGASSAHRVHADVGTGRPQGSPKRNSEDAMQHAAESRDAELAQKLLQWFLEEGKRECFAACLFTCYDLLRPDMVLELAWRHNLVDLAMPYFIQVDKLDALESLRKQEEHVTEPAPLVFDFDGHE

SEQ ID NO: 875335 - protein, 1149 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSSK

SEQ ID NO: 875336 - protein, 1561 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLMPCSMLQSRGMLSWPRSCCSGSWRKARGSASQLVSSPAMTCFAQTWCLSWPGGTTSWTWPCPTSSR

SEQ ID NO: 875337 - protein, 466 aa, Homo sapiens
MCLAENRMGGIEPLFKIISSGLTYLCFLSLDNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 875338 - protein, 1687 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKEQCGSGGSDRSAACQRGRLLSGASSAHRVHADVGTGRPQGSPKRNSEDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 875339 - protein, 1191 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSLGDRARLRLK

SEQ ID NO: 875340 - protein, 50 aa, Homo sapiens
GKIHWQGPLGGSGGGLEGHGREEGACLPATWVFPLPRRGAEISLYHLDLS

SEQ ID NO: 875341 - protein, 115 aa, Homo sapiens
MLPPGQIPNPTLSTHTLSSGQERPENVCTNGFREALEIKEPEAATHGSQKLNAAQTTGMTSPILLPPAIAVTKAALGPQLSTSEDKSWGDSCHLREKEKTKRQRLLLEDPFTWAA

SEQ ID NO: 875342 - protein, 38 aa, Homo sapiens
MTTRALVFIGYHPVCQGMWTQCLPCPLLRASRPRLCSH

SEQ ID NO: 875343 - protein, 41 aa, Homo sapiens
MAVRRFDEILEASDGIMVARGDLGIESCREVFIAQKLMIDV

SEQ ID NO: 875344 - protein, 186 aa, Homo sapiens
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQCKLSCALL

SEQ ID NO: 875345 - protein, 186 aa, Homo sapiens; identical to SEQ ID NO: 875344

SEQ ID NO: 875346 - protein, 186 aa, Homo sapiens; identical to SEQ ID NO: 875344

SEQ ID NO: 875347 - protein, 79 aa, Homo sapiens
HGSFDSHVYKDATGVPRGVPDKFKARNQTASGFESVLFWWSTVNKNVDRINYIYYNQQRFVNYTRHAIKGTASQLGPIN

SEQ ID NO: 875348 - protein, 479 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 875349 - protein, 110 aa, Homo sapiens
ICSFCPVVSLMGFFSLFAGLLSAMALVGDPAGGQTPPPFWVWTRAPGGGILQWSPRLSRDGVSAEAGAPISHWKGPGVWGSPLPGNPGSPPLPAACPPASASLWVLVWEP

SEQ ID NO: 875350 - protein, 133 aa, Homo sapiens
LQPILTRPIPSFPPHFPFCLPSCSLPHLQLCHVTVALLLKVCSLISGPSSCHFKTSPPETMSSSKGRKQLLKFSSMCGWSEEGCWDKILREKPQPRGMGPNTEGQNLNQKHLYDEKVKKKKDDSKMVLELGTS

SEQ ID NO: 875351 - protein, 74 aa, Homo sapiens
CSWGMVSTFSSKFLGTPDQCQHVRNAPSRFCPERAKQESSSVCHIFVESCPFAVNLNSGKVKSALEPNENFKRS

SEQ ID NO: 875352 - protein, 75 aa, Homo sapiens
SLEEVRGGPVWAEPEGGALGTSWWLDVGHEGKEALGITSGMAWPDLMELLSTEMVKSTRRAGVGAAGAQFGTRQA

SEQ ID NO: 875353 - protein, 33 aa, Homo sapiens
LLPSGVTGAQVKHNFGSHLLPNQPHALQTSLTT

SEQ ID NO: 875354 - protein, 104 aa, Homo sapiens
MPQNTTNKKPTHTLAGGCYSAIGCRLLFRSLQQSGKEVFFLPELRRPVFSTNVSSGLANKEVRSHCEKTIILNNRPINGWQKCHARPSEDGAACLKSHHGSDIL

SEQ ID NO: 875355 - protein, 220 aa, Homo sapiens
PLQQHFAASISPPESRRLAPFLGSAPLPSSPIPSSPIPSFPPHPDLLPFPLLPPPPPPAAPSFPPASVGRQRQQRRGRPQSPSVSRLRGNQVSVPLLSSSPHRPAPQLGFSAGFPSLSPPCLAPALPSLSTRHHAPSPGRSPGFLTALCAAPTPPGCRETPSSSRWTQASWTLALPLRGPPISRRDPVDFVGSGPRLGPWFTSASSLPRSRSSEPEGGFA

SEQ ID NO: 875356 - protein, 114 aa, Homo sapiens
GERRFEKSARRDGARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHL

SEQ ID NO: 875357 - protein, 85 aa, Homo sapiens
QRLAGVGVAGTAALEVLRELQQRGPLASLGYPLFFSLTFPVQMVVPALLAGGNMGNGGASLNLICEGIEEGVVKRRGGEGEAALT

SEQ ID NO: 875358 - protein, 43 aa, Homo sapiens
RSPLSIPTEKDREAKFLAYPGRCPCELPVSCKRWPLNHRASVC

SEQ ID NO: 875359 - protein, 118 aa, Homo sapiens
SIPHRFPGVEFVVPRTGFYCKLCGLFYTSEETAKMSHCRSAVHYRNLQVKIHSPCPACQGLPSLHNRARCLASLALLASESSSYLQGLLQATGYLPFPKHTRLFSASVSVSFRYMENP

SEQ ID NO: 875360 - protein, 71 aa, Homo sapiens
MTKLQWLFGFLEHSQRPAISPENFLSASWTPWFSPGTQQDCSEYLKYLLDRLHEEEKRAPGSARKAEAEAV

SEQ ID NO: 875361 - protein, 232 aa, Homo sapiens
FYEDPEGARWRVHSDKNGEIDHHREQYENLKWTLERKLEELDGELALQRQELLLEFESKMRKREHEFRLQADNMSNTALSRELKVKLLHKELEALKEAGAKAAESLQRAEATNAELERKLQSRAGELQDLEAMSRARVKDLEDKLHSVQLTRKKEEETFKRKHEELDRLAREKDAVLVAVKGAHVEQLQELQTRVLELQAHCETLEAHLRRAEWRQADTAKEKAPPRAIERV

SEQ ID NO: 875362 - protein, 224 aa, Homo sapiens
MRKREHEFRLQADNMSNTALSRELKVKLLHKELEALKEAGAKAAESLQRAEATNAELERKLQSRAGELQDLEAMSRARLRESFISRGVLCGSLAGQDWSLGDSTFSAHSRLVFAFISLAPFHKYLFLFRVKDLEDKLHSVQLTRKKEEETFKRKHEELDRLAREKDAVLVAVKGAHVEQLQELQTRVLELQAHCETLEAHLRRAEWRQADTAKEKAPPRAIERV

SEQ ID NO: 875363 - protein, 170 aa, Homo sapiens
MRKREHEFRLQADNMSNTALSRELKVKLLHKELEALKEAGAKAAESLQRAEATNAELERKLQSRAGELQDLEAMSRARVKDLEDKLHSVQLTRKKEEETFKRKHEELDRLAREKDAVLVAVKGAHVEQLQELQTRVLELQAHCETLEAHLRRAEWRQADTAKEKAPPRDE

SEQ ID NO: 875364 - protein, 283 aa, Homo sapiens
FYEDPEGARWRVHSDKNGEIDHHREQYENLKWTLERKLEELDGELALQRQELLLEFESKMRKREHEFRLQADNMSNTALSRELKVKLLHKELEALKEAGAKAAESLQRAEATNAELERKLQSRAGELQDLEAMSRARLRESFISRGVLCGSLAGQDWSLGDSTFSAHSRLVFAFISLAPFHKYLFLFRVKDLEDKLHSVQLTRKKEEETFKRKHEELDRLAREKDAVLVAVKGAHVEQLQELQTRVLELQAHCETLEAHLRRAEWRQADTAKEKAPPRAIERV

SEQ ID NO: 875365 - protein, 45 aa, Homo sapiens
GGWLSAHWLGPVPLIFQQASWVLLTQQRWSPRDNSRNVYGISWPR

SEQ ID NO: 875366 - protein, 100 aa, Homo sapiens
CLCGEVGLCVCVSVCGGGAVCVWRRGCVCLRRQGCVYVWRLGCVCVCGGWAVCVCGGGAVCVEAGLCVCVEVWMLCGGVDAVWMCGGVVVIPSPYFVVVA

SEQ ID NO: 875367 - protein, 266 aa, Homo sapiens
MGTPLDSTGSRNSSRANKTHSTEKLKMTATNMTHKQQGINNSTVNKSETWGNQHNDCAKEHANKHAVQCTTPEMNPNTKEKYPKEEQRKRQGTQDKKDKKTEMKKGPKLSHKGEKKAETNKKTKKQEQKTNKRKTNRRLKNTKTIKTKKRQKPNARGYRERRKNKKQREEKNSKEAKERRDADNKRVSERKDKKKSAENKTKEEQSEGEGSKGPRASRDEQPKTAEADRKGRNRSQEGKIEKGNKRSGENLKQKTQKGKQTKRNRK

SEQ ID NO: 875368 - protein, 44 aa, Homo sapiens
MGGRWSPPLPSNQLATNGTETYEYTDYGGLIFNSYILPPLFLEP

SEQ ID NO: 875369 - protein, 153 aa, Homo sapiens
MADEIDFTTGDAGASSTYPMQCSALRKNGFVVLKGRPCKIVEMSTSKTGKHGHAKVHLVGIDIFTGKKYEDICPSTHNMDVPNIKRNDYQLICIQDGYLSLLTETGEVREDLKLPEGELGKEIEGKYNAGEDVQVSVMCAMSEEYAVAIKPCK

SEQ ID NO: 875370 - protein, 168 aa, Homo sapiens
LICIVSLPLSHSLQRGRGPRGLHRGETLRLESQSRQRVSKSKASEAWKHAGCRQTDFQHMVCWVETRELQRAGLAFGVAGKSLLGHKLHICIHAPSQLSALQQACTWVVSDGNNQFTTRQPGHLFLFMYFFGTEFHSCCAGWSAMMCSWLTATSASRVQAILLPQPPE

SEQ ID NO: 875371 - protein, 139 aa, Homo sapiens
KAKSSAVYHVKTLGQGVAHEVARNGLHFLPQKTTIALMKLKGFDESSKPYLIPFPKAWLRQASSSPTKFWSPRRLRKKYRNECMRLREDKAGKAQARGCYRRGIGGRSNPSPSGCTYLHGKSRVKSQLRKLAWSGKGES

SEQ ID NO: 875372 - protein, 112 aa, Homo sapiens
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGER

SEQ ID NO: 875373 - protein, 145 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHFLLFLLLFQQ

SEQ ID NO: 875374 - protein, 111 aa, Homo sapiens
MGNWAQRGGVTIPRELARSHSRARAVTRPELLSTLRTLEPGSPGPCAAPSFRRPRFNPRSARAVMSWARVPNSRGWADEAGMPGIIITCLLPLSWLLGLNEPLLRLAGKGV

SEQ ID NO: 875375 - protein, 123 aa, Homo sapiens
KIHCGQAPLLHQVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTEPSPRMNDIN

SEQ ID NO: 875376 - protein, 72 aa, Homo sapiens
VAGMIKEKRDLVWSREGGCLLGAIQVENKICGWVRWLTPVILARWEAEADDHFGCHMNGGRWKEPAAETRRV

SEQ ID NO: 875377 - protein, 120 aa, Homo sapiens
RSPLPPVGFGELIWCMQQPQKASFLRSGPSLQEPLVLWEIRMYHFQKTWLGTPLFHPHICPASPNTGSPPPTPKPPRNAASNGVKCPTSVVLESTGHTQIRALTPNDRQISWACVSPLLA

SEQ ID NO: 875378 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 875379 - protein, 69 aa, Homo sapiens
EFISVSKRSYPGQAGKEDLRLLQQGSRLLQEERERELNCAETKEELLITGVSKWKSIRKLNWVTLVILT

SEQ ID NO: 875380 - protein, 223 aa, Homo sapiens
MPAPVEGTDFPGAGRQAWGSPALSLPVAPPAVSPPSVPLPSHQVGAMFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGGVEGLGLMLVHLEIVAGEVSVCRMRLKLALMGSAFGTE

SEQ ID NO: 875381 - protein, 230 aa, Homo sapiens
MPAPVEGTDFPGAGRQAWGSPALSLPVAPPAVSPPSVPLPSHQVGAMFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 875382 - protein, 230 aa, Homo sapiens; identical to SEQ ID NO: 875381

SEQ ID NO: 875383 - protein, 122 aa, Homo sapiens
HILKKQAGDCDQGLHVGTWPRRGAELREKFGSANLWENSLRGFHVTAGGRGGQWALQTLQKDQVVWGKCTSRERQFSSSHVEVFPSPELQGGCYGSESQARIGGRAWAETGRGERSWSNFPP

SEQ ID NO: 875384 - protein, 104 aa, Homo sapiens
SISRMGEIAQSWSQTLHATGCVQLESRTQRPARPLPSQGDPGPPGHRSPLKRLPPLNPRPRVFFCSRHWAIALCLFGRNDLYEKLYFWDSLIPSSLRTVQFFIS

SEQ ID NO: 875385 - protein, 122 aa, Homo sapiens
HWQSKNTPHQTQADLTLQLLQSLFQPELQVLQSQATGPATRGRQPPLAHCQEPCQVGPRHPHGAHPPVSQEHLRLRSVRGSKRGKRCLSLHTALHPVYPKIKDLKKPFVFQKTTHPDNLCTH

SEQ ID NO: 875386 - protein, 124 aa, Homo sapiens
MSPAARLRLGVAEQESMEIRCVKRVTAWRPSFPRGHRGVLCEVRWSMPPLLLQRPDTSPLHQFTTHVNNCRGQLIYGWKKMFFTNFSLQEHRDKTQFTESSISATKECEASETSASQRSEFGGI

SEQ ID NO: 875387 - protein, 118 aa, Homo sapiens
HPTFDNPVPSKSEAKDNFFEVFTPVFERNSRWSNKKNVPKLGDMNSSFEDVDIFYSFWYNFDSWREFSYLDEEEKEKAECRDERRWPLAPIRQLHCYQVSYQIFERMVLNLKPNISFY

SEQ ID NO: 875388 - protein, 482 aa, Homo sapiens
FHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRACELCIRAAIEQSMKEGEEAAE

SEQ ID NO: 875389 - protein, 161 aa, Homo sapiens
MGARMVNLFFIFFFLFCLHLPCPPPNSSPGVFILCYLAEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGRQQF

SEQ ID NO: 875390 - protein, 104 aa, Homo sapiens
KELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNVSPH

SEQ ID NO: 875391 - protein, 327 aa, Homo sapiens
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKKNRLFSKVLVTIKKVYMKERSFKGVEFGKNLGLKSSLIRKPRIVSRGRRPRSQQYSVLFKQLGVNTVRKCYKCNICGKIFLHSSSLSKHQRIHTGEKLYKCKECRKAFSQSSSLTQHLRVHTGEKPYICSECGKAFSFTTSLIGHQRMHTGERPYKCKECGKTFKGSSSLNNHQRIHTGEKPYKCNECGRAFSQ

SEQ ID NO: 875392 - protein, 264 aa, Homo sapiens
ATGNVSELGVPLASCAVWSCAPPAEAGPGAFSKRGSREGEMARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGHRTALSVRVITIHHRSMQDRLQVRLGPLAKSRFATISSRTRHAISLPRATGLLCTGLSVSVLTWTHARHYATRVGIRPPYEAGDTLCTSRRP

SEQ ID NO: 875393 - protein, 148 aa, Homo sapiens
LEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 875394 - protein, 134 aa, Homo sapiens
NHDGKKLRKLPSDKRLIIRKYKDLKQVYRKKILVIQLKMGKRFEYIFPQRRHINGKQAYERYSTQNRHMKRYLTSLIRELQIKTTMRCHVTPVKMALSKKKKITNASEDVEKREPPYTAGGVKGKYLRPPELRS

SEQ ID NO: 875395 - protein, 120 aa, Homo sapiens
HDHRGLFPVPPRLPPSVLHAAASQPGDPFKTQSDQVLPLLKTLSDSPQTWIKIPVPRPDLQGPGWSVLDLSASGLSPSQLPLHSPLPGSFLEDPSLLVGLPDLPLPCTDPRPPTSLHTSL

SEQ ID NO: 875396 - protein, 102 aa, Homo sapiens
GKQGNHQWPPRSQAWGFLSNSLNPVSPWPAQILLLMVCPVAFSLTTVLVLDEPFVFQGSLLLYFLLPTSYSFVFNNVFKHLNCCIYSMPGRYLSTGGGGIRR

SEQ ID NO: 875397 - protein, 67 aa, Homo sapiens
PRWVHSLWGTVTASRQDGCSVIVTHQVSWEQRRWLPTRSRCADVMGENGERQARQAFQFESSAIQKL

SEQ ID NO: 875398 - protein, 82 aa, Homo sapiens
RVDLRQNCEWSDFNMPESAQRNPGRRHQVVADTLGPQGPGLGGGAASRAAKLPAHAVPSEHQSRDLLLTLDPSDELLLQSGR

SEQ ID NO: 875399 - protein, 407 aa, Homo sapiens
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGREFHSEKQG

SEQ ID NO: 875400 - protein, 739 aa, Homo sapiens
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGLDARQAQVVALSSGTKCISGEHLSDQGLVVNDCHAEVVARRAFLHFLYTQLELHLSKRREDSERSIFVRLKEGGYRLRENILFHLYVSTSPCGDARLHSPYEITTDLHSSKHLVRKFRGHLRTKIESGEGTVPVRGPSAVQTWDGVLLGEQLITMSCTDKIARWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 875401 - protein, 35 aa, Homo sapiens
MGHPERCKLGLEDVECSQGKRVGWSDCKEKVSGGG

SEQ ID NO: 875402 - protein, 69 aa, Homo sapiens
ELGLQACATVPSIGQAVLLLQPPEELGLQACATVPSIGQAVLLLQPPEELGLQACTAVPSVPFTFKSST

SEQ ID NO: 875403 - protein, 677 aa, Homo sapiens
MSDPRQSQEEKHKLGRASSKFKDPPRIMQSDDYFARKFKAINGNMGPTTSLNASNSNETGGGGPANGTPAVPKMGVRARVSEWPPKKDCSKELTCKALWESRSQTSYESITSVLQNGQSDQSEGQQDEQLDLDFVEAKYTIGDIFVHSPQRGLHPIRQRSNSDVTISDIDAEDVLDQNAVNPNTGAALHREYGSTSSIDRQGLSGENFFAMLRGYRVENYDHKAMVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDFTGTHSLYTTYRDLR

SEQ ID NO: 875404 - protein, 118 aa, Homo sapiens
VGFVLHLRYQLNHRTVKHQMVLGNANSRTCLLDGIYGPTLGQRGAHCPGGGGPMPGSIHHQLVEDSLGLKRTSAVVWQYSLWACGGGGHGVRHLCLGKAEAREGRTASCGFSASSPAV

SEQ ID NO: 875405 - protein, 96 aa, Homo sapiens
MQAAAQTCGAEAREHAHWRQCECPLKGFAAQGTDGLSRTQVGQARVGRTKGRETKGPSSCSSQSWGPGYNNLDLRSQEDSELGQGTMEVKAIDSEV

SEQ ID NO: 875406 - protein, 110 aa, Homo sapiens
MSAFPVGKTDNVPICAFPCKIQLSQEHEQISLARPPHPQHLITCLILHDATGGLQGCLHEVITSLPRPGLSMPSLARRRKQIPGIHFQVLHDVMSEEKTGIYETGAITRT

SEQ ID NO: 875407 - protein, 38 aa, Homo sapiens
MEPVLDHFLQLPTGPHPPRATPSEHLPPGAAVSFPVVK

SEQ ID NO: 875408 - protein, 149 aa, Homo sapiens
AGSQARGTRDPEAAQAMLHHLGAQLQAPGNSQAGWRAQPRRPGRGCRRGCGQARRSARRRLHRGRNRPSAPSPVAADGPWRGPDLSSEEKRGGSQGQAGPQAGRDACLRFRDIPRQPRRTRKPAAPVSLCDSVRNHQIVFHGKCIIFYS

SEQ ID NO: 875409 - protein, 183 aa, Homo sapiens
LCPRGSTPLLQQGEPETHTASGIPQRDQAGREEKGVVVSSYSLHVPDPVPWELCSSRMLAPVRWVSRRNRTVGRPREQLASGTSSGSLRTCSPSSLLFPLRQRLGRTHRQPLVTRTPHPVCLRRNGVCESGLSLHAAVSAEPGAGVASASQQSEHAQLVQGTVFCLHCSRHRHLHLMMITRQL

SEQ ID NO: 875410 - protein, 183 aa, Homo sapiens; identical to SEQ ID NO: 875409

SEQ ID NO: 875411 - protein, 43 aa, Homo sapiens
EQMPSSPPVPCSSESLPPRTWPWCGSQAEAGSHPPPLSFLQWC

SEQ ID NO: 875412 - protein, 69 aa, Homo sapiens
GSYCAPVKFKGKDRLSGLLSRGAGRGRGGGRWPLSLCNRKRGECLGQKMTSEDTKRFTVSGATSELLWW

SEQ ID NO: 875413 - protein, 526 aa, Homo sapiens [sequence omitted]

SEQ ID NO: 875414 - protein, 83 aa, Homo sapiens
VAMVIADSRGYTRETTFDIPFIFFNIITVDNSYFVEAVSFALPNYDKEETEERRGGNIVSLSPGLFILWEFKSSPFLPRHIML

SEQ ID NO: 875415 - protein, 304 aa, Homo sapiens
MLKKLSDCIFLWFCIVPPMEDCKEQEPIMDNNISLVPFERPAVIEKLTGNMGKRKSSTPQKFVGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 875416 - protein, 500 aa, Homo sapiens
METEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGERPFHCNQCGASFTQKGNLLRHIKLHSGEKPFKCPFCSYACRRRDALTGHLRTHSVGKPHKCNYCGRSYKQRSSLEEHKERCHNYLQNVSMEAAGQVMSHHVPPMEDCKEQEPIMDNNISLVPFERPAVIEKLTGNMGKRKSSTPQKFVGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 875417 - protein, 121 aa, Homo sapiens
NTRPQQSENASLLNYHLVWNETDSSVALAAAGPGWDGGDAGSLDMPGTLPLPASLWIAASLGHLDSTKQKCCERAILLKKLDFERAKEGMPTKKYSVFPITLALLQKNHTFYPRLALSVKS

SEQ ID NO: 875418 - protein, 142 aa, Homo sapiens
PLPEFASGPGAAFFHSGRLQRSLTKDSAGCFSQCRSRAMLVLRSGLTKALASRTLAPQVCSSFATGPRQYDGTFYEFRTYYLKPSNMNAFMENLKKNIHLRTSYSELVGFWSVEFGGRTNKVFHIWKYGNSAHRAEVRALAL

SEQ ID NO: 875419 - protein, 100 aa, Homo sapiens
PLSSLPKLILKAPFSLATLRAPLCFCRGVEPCQGRPCVGPSPSDPPHQSLLLNPTPGGSSAESRTAAELGATGHEESGVEEKTAEENPPAMLNCGFLSRL

SEQ ID NO: 875420 - protein, 43 aa, Homo sapiens
DDGLSLKGTIIFPYVEKFLCQSQQNDTITVNTERMSMPLPALI

SEQ ID NO: 875421 - protein, 57 aa, Homo sapiens
LTLPFSLKDHLLRNALADHLAQAAPITHYPLFYCHLKFSVFTHCLGLSYQIQEPLVA

SEQ ID NO: 875422 - protein, 673 aa, Homo sapiens
NEGAGGGGSVMASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGGLRTSQHPRETGQEASGDQRS

SEQ ID NO: 875423 - protein, 740 aa, Homo sapiens
NEGAGGGGSVMASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGSSSSSSSSVKQYISSHNSVFNHPLPPPPPVTYQVGYGHLSTLVKLDKKPVETNGPDANHEYSTSSQHMDYKDTFDMLDSLLSAQGMNM

SEQ ID NO: 875424 - protein, 393 aa, Homo sapiens
MPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGSSSSSSSSVKQYISSHNSVFNHPLPPPPPVTYQVGYGHLSTLVKLDKKPVETNGPDANHEYSTSSQHMDYKDTFDMLDSLLSAQGMNM

SEQ ID NO: 875425 - protein, 393 aa, Homo sapiens; identical to SEQ ID NO: 875424

SEQ ID NO: 875426 - protein, 771 aa, Homo sapiens
NEGAGGGGSVMASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRDLWGIARNIGVNVVKIFSSIENDGALVIFVSTSKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGSSSSSSSSVKQYISSHNSVFNHPLPPPPPVTYQVGYGHLSTLVKLDKKPVETNGPDANHEYSTSSQHMDYKDTFDMLDSLLSAQGMNM

SEQ ID NO: 875427 - protein, 176 aa, Homo sapiens
NEGAGGGGSVMASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRGR

SEQ ID NO: 875428 - protein, 740 aa, Homo sapiens; identical to SEQ ID NO: 875423

SEQ ID NO: 875429 - protein, 393 aa, Homo sapiens; identical to SEQ ID NO: 875424

SEQ ID NO: 875430 - protein, 133 aa, Homo sapiens
CRQAKKKTHQLWANDAISEDNFMFLVLVHSFNKCLFFVISMQMSYRLLEIILFYSKFLVVHSQYDMALTKQFISTMDGQVGWLTPVIQQFRKLRQEDCLRAGIQDQPRQHSETLISTRNLNKKEKKREAWTLV

SEQ ID NO: 875431 - protein, 36 aa, Homo sapiens
KVRAGYQYGRRTVLWSETPAAVQFAEIMKVEGISQT

SEQ ID NO: 875432 - protein, 69 aa, Homo sapiens
IRPASVLGRCQVISTAILIYPVHITKDETTLSSSASKTHCGWFHCGTNSLQLLLTCYSKVISSKVPPIR

SEQ ID NO: 875433 - protein, 119 aa, Homo sapiens
MKLACFMVLSLPLPRNQCRISRMPEDSSGFGSGIQLKECLSGRLCPEDKEMQRQRQRTPSWEGKLALPLPKTVPATTDEKQHSPHSHLTRSFDRPELLCPTDPRECPFASSGLCHIVLP

SEQ ID NO: 875434 - protein, 32 aa, Homo sapiens
GGGKKDDKDKKKKYEPPVPTGVGKKKKTKGSD

SEQ ID NO: 875435 - protein, 114 aa, Homo sapiens
QPSPHSRHGALHYPVTSLLSYLSHLIPPLTLGNPGWFLLLDNRIVFSRVSSEWNHTIMNEKHTGILFCVWPLWLGIMSLQILSHCCMYQYFIRFYFRVAFHCIDISSFAYAFIY

SEQ ID NO: 875436 - protein, 266 aa, Homo sapiens
TFVSRCIWSSRSPLRYSVSSAPRGPPSVALCPVGIGRSTAKMPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSSCL

SEQ ID NO: 875437 - protein, 254 aa, Homo sapiens
TFVSRCIWSSRSPLRYSVSSAPRGPPSVALCPVGIGRSTAKMPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLLCSALGATSSRREAAEPATTDPAEPPPPRAPMAAAKDTHEDHDTSTENTDESNHDPQFEPIVSLPEQEIKTLEEDEEELFKMRAKLFRFASENDLPEWKERGTGDVKLLKHKEKGASAP

SEQ ID NO: 875438 - protein, 143 aa, Homo sapiens
VCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSLTPYYT

SEQ ID NO: 875439 - protein, 505 aa, Homo sapiens
TIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEVLQNKSQQLRAWEAEKYNEIRTQEQNIQHLNHSLSHKEQLLQEFRELLQYRDNSDKTLEANEMLLEKLRQRIRDKAVALERAIDEKFSALEEKEKELRQLRLAVRERDHDLERLRDVLSSNEATMQTMESLLRAKGLEVEQLSTTCQNLQWLKEEMETKFSRWQKEQESIIQQLQTSLHDRNKEVEDLSATLLCKLGPGQSEIAEELCQRLQWKERMLQDLLSDRNKQVLEHEMEIQGLLQSVSTREQESQAAAEKLVQALMERNSELQALHQYLGGRDSLMSQAPISNQQAEVTPTGRLGKQTDQGSMQIPSRDDSTSLTAKEDVSIPRSTLGDLDTVAGLEKELSNAKEELELMAKKERESQLYPSNMGEKVSAF

SEQ ID NO: 875440 - protein, 664 aa, Homo sapiens
TIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEVLQNKSQQLRAWEAEKYNEIRTQEQNIQHLNHSLSHKEQLLQEFRELLQYRDNSDKTLEANEMLLEKLRQRIRDKAVALERAIDEKFSALEEKEKELRQLRLAVRERDHDLERLRDVLSSNEATMQTMESLLRAKGLEVEQLSTTCQNLQWLKEEMETKFSRWQKEQESIIQQLQTSLHDRNKEVEDLSATLLCKLGPGQSEIAEELCQRLQWKERMLQDLLSDRNKQVLEHEMEIQGLLQSVSTREQESQAAAEKLVQALMERNSELQALHQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFLPIQRGAAAGDDTEDTSTEFTDSIEEEAAHHSHQQVSQCQGLGLPGWTAHSPSEV

SEQ ID NO: 875441 - protein, 87 aa, Homo sapiens
PLTTLPQPLISYSTKNKTLKPPHTPPCSLISPFLDLSQPQGSEMEANEAESSRRLRGPEPQQVLRLERATGKMRPFTGLCLQLTPID

SEQ ID NO: 875442 - protein, 238 aa, Homo sapiens
GARAAARLPPRGMRDPGVPRTWLVPRQFRGCLETGLWLPSSPLRLFFFFFFFLSPPRPFYNSSRGRVGGHLPLEKGPLGRGGARGITAPRGFSGGAPMEDLPWAAPQKHFVRPPIFFPPGVPLFWARDRAPSSYAPPNLEGSPLLQPGEQLIAAQSALRKRGRSTSNKNCVCPVEPPHTFLLLPNCARYSTYGAALSLLPPPATRFPYRGDPKYNTVAKEGAGHPLWGHIPVSTLPPC

SEQ ID NO: 875443 - protein, 122 aa, Homo sapiens
MVWASKLAFQGGRKKRSLEASTTTQRGLLTHSTPYCTRAGRKEGAPVWGLQEQAVLRGQPGLKNKEMDEGPGVVAHACHPSPLGGQGGQITLRSGVRDQPGQHGETPSLLIQKLARHSGTHL

SEQ ID NO: 875444 - protein, 94 aa, Homo sapiens
QLRNTQWVFGIVVYTGHDTKLMQNSTKAPLKRSNVEKVTNVQILVLFGILLVMALVSSAGALYWNRSHGEKNWYIKKMGKCRGGLLVPVEENHF

SEQ ID NO: 875445 - protein, 105 aa, Homo sapiens
QLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLL

SEQ ID NO: 875446 - protein, 88 aa, Homo sapiens
GSGCNAGRGSSGPGSGGSRWGAWLPPSPPPRLPSSPRAPSPPASSLSGRHHRHPRIHKSVKARCFHFWMTYRAVATLPTKRLFTLLSY

SEQ ID NO: 875447 - protein, 78 aa, Homo sapiens
MSCIGAPPPPPPPPPPPPPPPPPPPPPPPPPPPPPPPPPPPPLPPPPPPPPPPPPPPPPPPPPPPPPPPPPPPPPPPP

SEQ ID NO: 875448 - protein, 101 aa, Homo sapiens
SHQYFASQLHTHASLPCFVTVGVWWDEGASLPLFLGSSSADCQQDMSALAAQLKDSSFQSQLESPSLPTSAQPLWSSSGPGQPREQEVILHPLDHSLGPGL

SEQ ID NO: 875449 - protein, 78 aa, Homo sapiens
VLMRQKGTHWAPEVTKSSQCGLRFKEGGLLGVAYLKSLHQKLKQERAGEDSCLIRQPTNMCPVYAGRHQCCLEALTVL

SEQ ID NO: 875450 - protein, 288 aa, Homo sapiens
TRYHQAASDSYLELLKEATKRDLNLSDEDGMTPTLLAAYHGNLEALEIICSRGGDPDRCDIWGNTPLHFAASNGHAHCVSFLVNFGANIFALDNDLQTPLDAAASREQNECVALLDKAATAQNIMNPKKVTRLKEQAQKNARRQIKECERLQEKHQNKMAHTYSKEESGTLSSSKGTFSRSSPSNASAPGTFGSLSKGIKDTFKIKFKKNKDTAEQVGKEGRSGQRNVMEVFREEEEDSFSGDFKEKLQLSAEEDGSVHHESILNRPGLGSIVFRRNRISSPEDISDS

SEQ ID NO: 875451 - protein, 179 aa, Homo sapiens
TRYHQAASDSYLELLKEATKRDLNLSDEDGMTPTLLAAYHGNLEALEIICSRGGDPDRCDIWGNTPLHFAASNGHAHCVSFLVNFGANIFALDNDLQTPLDAAASREQNECVALLDKAATAQNIMNPKKVTRLKEQAQKNARRQIKECERLQEKHQNKMAHTYSKEEETLRWKAHREAT

SEQ ID NO: 875452 - protein, 125 aa, Homo sapiens [sequence omitted]

SEQ ID NO: 875453 - protein, 79 aa, Homo sapiens
GQGPTVSTGMARGETQCSAHRGLGAGRSHLLPSRVPASQPSHLSHPGAMLRWSLGPPVPALLLPGTLAEGSALPPLHTH

SEQ ID NO: 875454 - protein, 176 aa, Homo sapiens
KRGTVMTVHFDTTILPRDAMTSMCVTLEGKGLHLSLLVPRMGFTVDVPLTPPLHQNVDAQRTGTPEPQGGKEEEHSQDQKSEETMMSHRSQGVSSCSRGEPKSGDSLSKLLAGGELVVVISSQLWQWLWPNSWRQEQGSDKNQQLHRGLINFQSSIQKRTGHAQAAPKRKDKGEEF

SEQ ID NO: 875455 - protein, 183 aa, Homo sapiens
KRGTVMTVHFDTTILPRDAMTSMCVTLEGKGLHLSLLVPRMGFTVDVPLTPPLHQNVDAQRTGTPEPQGGKEEEHSQDQKSEETMMSHRSQGVSSCSRGEPKSGDSLSKLLAGGELVVVMCLSTCSSSSQLWQWLWPNSWRQEQGSDKNQQLHRGLINFQSSIQKRTGHAQAAPKRKDKGEEF

SEQ ID NO: 875456 - protein, 92 aa, Homo sapiens
PVPSPTPPLPASVPSSPLGKAAGLPRECPLVPPLALCPVLNPSSHTYPFSQGSLPQNFLSLDHGAVQGGQEAGWKDCKGDCFSCYPQVLKPK

SEQ ID NO: 875457 - protein, 106 aa, Homo sapiens
PRRRSLQCVEITPLHSSLGDRARLCLKKKRQGRRRGWVSGLLRGWEIKRAFVLPGLLGVALCRGRAKIASNPDSQIGWRSGQAAVEIEESRLLGRHSSQLEAPAIP

SEQ ID NO: 875458 - protein, 71 aa, Homo sapiens
MVTRHEEEVGYYRDMSCLTAILLLYLPEEDNFWALDQRMAEERHSLQGKSGDFLKPLYENGETSQEMLMDS

SEQ ID NO: 875459 - protein, 140 aa, Homo sapiens
PKHQPHSRPDWQQQTPKDKGGIFNKVSRFPRVGHSTVTCCKRQASQSPSPESLPLPALLRLNACGGQKTWGLRSTPSEAHTPLQRRARGLPPGRVPAAANQLFAPKPAPPLPWLMAALNERNRCRLRIYECAGEEGRDIM

SEQ ID NO: 875460 - protein, 41 aa, Homo sapiens
MLTGRLLTSYCVAWFLTGHGLVTICGLGTGDPDLKNRGHTH

SEQ ID NO: 875461 - protein, 138 aa, Homo sapiens [sequence omitted]

SEQ ID NO: 875462 - protein, 116 aa, Homo sapiens
MPHLLGNNQMSFCSFPFSWALYWETVYAHRPRTPPKISTFRAPSSSPLLRQPRLTPRISPCSFLCSVSITRLYGRHMPTEPPPLLLPRGLKPALGQSTEAAFSSGQAAGASGVLEV

SEQ ID NO: 875463 - protein, 91 aa, Homo sapiens
ARNIWIHDSSLALTKEEQLPILSSLGLRDTQTTSLLNSLFAKAWAEDQNRKRGEPNDNSEEMIRTEKERRKSKRPDPHVDPIVSSFQPPSL

SEQ ID NO: 875464 - protein, 129 aa, Homo sapiens
MNEAQKKGSRSPQGHRGSVQGQISSWGHAEICAVHNQPGDAAPARSMHHWVHVNISARSRAQKKRAKGTSRAAASVTLDGGPGCEALLDAPFGDPGVRLAWPRRVRGLEAFVCLSAGRGPGWGPRAGRP

SEQ ID NO: 875465 - protein, 164 aa, Homo sapiens
EISSDSHAPLHSVTNSPEVAVKKLNPQKEEQVHLENKENEPIDSEVSLDYNIIFHSVTGRSEDPIKEISLHTKEHMYLENKSVFETSLDSDVPLQAATHKPEVIVKETWLQREKHAEFQGRSTEFSGSKTSLDSGVPHYSVTEPQVAVNKINRKKQYVLENKND

SEQ ID NO: 875466 - protein, 346 aa, Homo sapiens
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 875467 - protein, 346 aa, Homo sapiens; identical to SEQ ID NO: 875466

SEQ ID NO: 875468 - protein, 36 aa, Homo sapiens
MGPTSMSHTECSEQRLAQICAHCRFARMEGCAIHKR

SEQ ID NO: 875469 - protein, 168 aa, Homo sapiens
MSGSGIGTFILAPVVQLLIEQFSWRGALLILGGFVLNLCVCGALMRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRCLKN

SEQ ID NO: 875470 - protein, 168 aa, Homo sapiens; identical to SEQ ID NO: 875469

SEQ ID NO: 875471 - protein, 143 aa, Homo sapiens
QSEVRGLSTSGSLGEAKTPPPEPHSLGGRKTPPRSTWREGRKPPAPGHGEGQKPRTSKSWSWRLRLPSLEHEGAGSATPENCPNPVPPGTGLGSPGARRELRRRRAAAPRRSGKLTGGHPDSSAPPTRPYCARGEGARCSPAA

SEQ ID NO: 875472 - protein, 156 aa, Homo sapiens
ASFRASIVRASLQEQEGQPRPQSPRSQVRPEADPGPSPLTKMSAENEYRPPSPPKLAAERDKPSPRLRPRGVPVLPGIAQDSSQRAPRTRGTARSGAGSLQRPPGPHRPVPRPEGPARPNKVGAGSPGTAPHTAGCPPARRRGTRGRARGRRRGSR

SEQ ID NO: 875473 - protein, 162 aa, Homo sapiens
QQGNEECFDLRKMKNEDRTRGFKLTAAKIAECGFVFETVPQISTYLMRVVDKDSIRSGGPVVVLVQLEREKKVTGPVIAPLFLQKREEGWWVVIGDAKSNSLISIKRLTLQQKAKVKLDFVAPATGAHNYTLYFMSDAYMGCDQEYKFSVDVKEAETDSDSD

SEQ ID NO: 875474 - protein, 140 aa, Homo sapiens
TESQLLPDVGAIVTCKVSSINSRFAKVHILYVGSMPLKNSFRGTIRKEDVRATEKDKVEIYKSFRPGDIVLAKVVTEISLGDAQSNYLLTTAENELGVVVAHSESGIQMVPISWCEMQCPKTHTKEFRKVARVQPEFLQT

SEQ ID NO: 875475 - protein, 60 aa, Homo sapiens
METDLAEMPEKGVLSSQDSPHFQEKSTEEGEVAALRLTARSQNCLFVEHRKRRKFAFPMS

SEQ ID NO: 875476 - protein, 130 aa, Homo sapiens
METDLAEMPEKGVLSSQDSPHFQEKSTEEGEVAALRLTARSQAAAAAAAPGSRSLRGVHVPPPLHPAPAREESARTPAAAGRAAKMAEAPASPAPLSPLEVELDPEFEPQSRPRSCTWPLQRPELQASPA

SEQ ID NO: 875477 - protein, 108 aa, Homo sapiens
QYKNGQLLKPNLASPIIRTSLYKNLPSANIIFLIQPKAAFKDFLKPTPIDSSPLFSPATLIGQALLYICATVNSRSIVGALDPAQCNTTSTIIDISQNFVSLNILNIK

SEQ ID NO: 875478 - protein, 77 aa, Homo sapiens
PGAGGSVTRPLPCHSWRLTNSRRRRENSPRHPRHQPSRSAALQDLPAGSPGVRGSAEGPSPRPLGSEAHPWNTNSFS

SEQ ID NO: 875479 - protein, 85 aa, Homo sapiens
TELPRNITYHCKNSIAYMDQASGNVKKALKLMESNEGEFKAEGNSKFTYTVLEDGCTKHTDGIFSHQANQKQYRRDHATALQPGP

SEQ ID NO: 875480 - protein, 76 aa, Homo sapiens
PGLGSRVSPVTWEMAPGPSPPLLPQGPLLTQGHQAGPLAESSVSPLWRVKSSVWGAISGSGAARPTGLSSGRTAEL

SEQ ID NO: 875481 - protein, 215 aa, Homo sapiens
MSETVPPAPAASAAPEKPLAGKKAKKPAKAAAASKKKPAGPSVSELIVQAASSSKERGGVSLAALKKALAAAGYDVEKNNSRIKLGIKSLVSKGTLVQTKGTGASGSFKLNKKASSVETKPGASKVATKTKATGASKKLKKATGASKKSVKTPKKAKKPAATRKSSKNPKKPKTVKPKKVAKSPAKAKAVKPKAAKARVTKPKTAKPKKAAPKKK

SEQ ID NO: 875482 - protein, 121 aa, Homo sapiens
PCGHSIHHDYHQYFSYNQMVASFSYSPIRLLEVCVPLPKIFIKRQAPLKVSLLQDLKDFFQKVSQVYVAIDERLASLKTDTFSKTREEKMEDIFAQKEMEEGEFKNWIEKMQARLMSSSVD

SEQ ID NO: 875483 - protein, 144 aa, Homo sapiens
HNTPLENKPLPRSQTPGGIRPQLRRDTSRSGGQDLVLAPRLAGISELPAPGRAPLPRPAPHKGPLSRRAPGTPVPEKFQEKNQRESKIGELRRAGGARPRWQLLRDPKEEGSIEGYSGNCKNPKLQFEQEVDFFFFLSRDLGRQ

SEQ ID NO: 875484 - protein, 131 aa, Homo sapiens
SPLVSAPLRARGASGASVLPAAPARCPQPSLRCTERARRSHSPLLPRPRLTWLSGHPEATKAAPCPDAGLPLSLTSLPGLWSVFCVRIWIPVALERQKGRGDRKAAKEASGRSLPQPPPAGNLGGALGVSV

SEQ ID NO: 875485 - protein, 199 aa, Homo sapiens
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISGQANRYAEQLMMLLIPDYSESVALGAGNGGGPPSRCAGPPGGSPVVGS

SEQ ID NO: 875486 - protein, 158 aa, Homo sapiens
MDFSKFLADDFDVKEWINAAFRAGSKEAASGKADGHAATLVMKLQLFTKETSHQALQNMPKVLRDVEALKQEASFLKEQMILVKEDIKKFEQDTSQSMQVLVEIDQVKSRMQLAAESLQEADKWSTLSADIEETFKTQDIAVISAQANRYAEQLNDAC

SEQ ID NO: 875487 - protein, 102 aa, Homo sapiens
AGELEKNQAETHGCGGSTGKPLKAWAMVTHLAWANLQTQGYPTAQPGKPHSRHRNHKAHSNGTPPVRRVPHREPGCMILRSPNSRASLVCLDRERGEDWLQE

SEQ ID NO: 875488 - protein, 67 aa, Homo sapiens
AGGFSLSLFPGESSCELFLLQQCHAAPETCSHPPLWFILIPRASFPSSLVDAGMVWDRAVLIAPPWG

SEQ ID NO: 875489 - protein, 120 aa, Homo sapiens
AIQLTFKQVSKNFSEVFQKLVPGGKATLVMKKGDVEGSQSQDEGEGSGESERGSSSQSSVPSVEQFTGVGIRVSFTGVALALIFAIQKCDPAPFYLFDEIDQALDAQHRKAVSDMIMELA

SEQ ID NO: 875490 - protein, 102 aa, Homo sapiens
MLSHLHREFRDRKAVGRDVNGGSGVDEMVKCWRKEAIYEYDHCHSDKISGLLSLKKVSLCFYLKANHYAFLRKKKNGESGYAGKCLIQTISSLRRPRVTLYG

SEQ ID NO: 875491 - protein, 73 aa, Homo sapiens
MEMSLMQAPGNQYVSSVSLARYSLLDPQSGEIMLISPTSYENYARKLCGAYRCPVACWLEALTLKSGRPGWNS

SEQ ID NO: 875492 - protein, 66 aa, Homo sapiens
GDELDKMESSLVASELPLLIEDLLEHEKKELQKKQQLSAQLQPAQQQQQQQQQHSLLSAPGPAQAM

SEQ ID NO: 875493 - protein, 70 aa, Homo sapiens
IGIQGTYLNVIKAIYDKPTADIILNGKKLKAFPLRTGTRQGCPLSPLLFNIVLEVLARVIWQEKERHRNW

SEQ ID NO: 875494 - protein, 69 aa, Homo sapiens
GAARAEPPPEPQGRSERGLGASRAQTAPPGALSLAPGKEENPLPPGRAGRRAGSQPQAPGPRRSHGSQD

SEQ ID NO: 875495 - protein, 142 aa, Homo sapiens
VVHLPLGRTQGPGMAPDQGGTVLWENLWYVTTCTPVCAQPEMSWSQSPLERLQSTFMSPQDLKGPLRSRRACGGRSRGSDQPQGEWGKQRGSPQPPVPCLVFSGVSRHCLGLRDGHAAFGWGLRVEEGRLVGTGSKSFSCPC

SEQ ID NO: 875496 - protein, 231 aa, Homo sapiens
QCLKQYMQLAIREGCGPPITCPDMVCLNHGTLQEAEIACLVPVDQFQLYQRLKFEREVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIIC

SEQ ID NO: 875497 - protein, 113 aa, Homo sapiens
ERRREWKSSCPVCQQPGLAVSAREATEKPGDGGTQVCCQGLRRLKNAEDRLMGSAGRLHYLAMTAENPTPGDLAPAPLITCKLCLCEQSLDKMTTLQECQCIFCTAMDNVLMV

SEQ ID NO: 875498 - protein, 301 aa, Homo sapiens
ERRREWKSSCPVCQQPGLAVSAREATEKPGDGGTQVCCQGLRRLKNAEDRLMGSAGRLHYLAMTAENPTPGDLAPAPLITCKLCLCEQSLDKMTTLQECQCIFCTAIACLVPVDQFQLYQRLKFEREVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIIC

SEQ ID NO: 875499 - protein, 246 aa, Homo sapiens
AVCLFLADCPQGSSTCLRPSPATWQGGAPYRAIFAAGPRLSAPSAEAEEVPGGHTASNPTYEPLSSRRTKAPSEGRDSPSSPATSTHYLDRESGLGSVNSHPSRSPYNLEPAQPLSPSLKPMGPHCSVPRRPRMGSGKVSMCPQGQVSGPDSHPQGGGAQRAQSPPLGGPAAPAFPVSPASVPGILDLGLALRKRGSSVPQQGRGTLGLRDHISGCGENVNHISRISPPWAQPGHGPLKMFLIAGS

SEQ ID NO: 875500 - protein, 374 aa, Homo sapiens
LPQPPPLQPRLGSASPPRLAAPLAGSRAPSLSPFPRRCRRRAERSPAGHGLPLPRSLSRGGEVVGARRRRGGEERRVRGRRQGCALGSPPIPAGPAAPGRAGERRAARQWRKRGGGPGVSPREGAQGEGVRGGVTPRARGSSTCLRPSPATWQGGAPYRAIFAAGPRLSAPSAEAEEVPGGHTASNPTYEPLSSRRTKAPSEGRDSPSSPATSTHYLDRESGLGSVNSHPSRSPYNLEPAQPLSPSLKPMGPHCSVPRRPRMGSGKVSMCPQGQVSGPDSHPQGGGAQRAQSPPLGGPAAPAFPVSPASVPGILDLGLALRKRGSSVPQQGRGTLGLRDHISGCGENVNHISRISPPWAQPGHGPLKMFLIAGS

SEQ ID NO: 875501 - protein, 51 aa, Homo sapiens
MQRPYDSRTCIGSSHSRGPLSWAPCGPIAGSRQALSFEVPPCNYDPEKWIQ

SEQ ID NO: 875502 - protein, 97 aa, Homo sapiens
YCFSSASSLVSSSTKRASSFSATFFGMIVFARSFLFSPISFLHSSNFVLNFCAFSIFRKWMASSSGLGHSLAKSAWVFQTQAWSLPMLGFSSIISVK

SEQ ID NO: 875503 - protein, 111 aa, Homo sapiens
ENGDSTQKETNPAFRVQHHQALHFSYSDTAWFTGAGLPGPACSLHCQQYDELSSYCLLSKGPAETHVGSREAAALGENPMLHLYRHVVITSANAPGLQTTVCLLDALHQRH

SEQ ID NO: 875504 - protein, 68 aa, Homo sapiens
AGELMTGVLEEEVSCGELRALKEATHGGGLGTWQFQSIHHVKEGPCRSPKSMFSCLSLVDDGGWWQGH

SEQ ID NO: 875505 - protein, 97 aa, Homo sapiens
PSGGRGPPRVSPGQVTLSKPLWWARTSTRVTRPGDFSASPSTRVTRPGDSQQAPPVGEDLCTCLQRPKQKKTLAQESLDFTKRSQDCGFSGSAVSVV

SEQ ID NO: 875506 - protein, 105 aa, Homo sapiens; identical to SEQ ID NO: 767212

SEQ ID NO: 875507 - protein, 111 aa, Homo sapiens
RVKGKVAQPGLGGAGWAQPSISSGRPRQRAGGARWAGSSQLVAFEAPPTAVGEGQPRRVGSGPAAGWGGRGPAFPQQRRRPPWHVVRFWRHRPRWARHPGCQAHRQPRPVL

SEQ ID NO: 875508 - protein, 110 aa, Homo sapiens
LNNAAAVVLQPLSPVIGTCISSEVHCICQISGRQEDGKKRQGKRKEKEILPSYRIQPHVLYLESDYNVAAPNTAAPGPDCLEPNLGLPLSGLRSVAIESTSVQLSSSSIR

SEQ ID NO: 875509 - protein, 71 aa, Homo sapiens
DPFVMAERGKGFPIKNNKHLDVSRAWNLVTHYNFLSLLTGNEERCVVYVANIKEVHNLFLIVRKKSGELSH

SEQ ID NO: 875510 - protein, 46 aa, Homo sapiens
WKNKEFKKYPKYPVCDEKEHYYTNRLNGHLWNNKFPLINQYLVNLS

SEQ ID NO: 875511 - protein, 53 aa, Homo sapiens
MSNSYSSTKRHSKKTAIGETGRRPSSEPNLCGTLILDFPTSRVMRNKFMLFKP

SEQ ID NO: 875512 - protein, 36 aa, Homo sapiens
MMNILRATNNTTISKIILVITQFFLERLFTTENVNT

SEQ ID NO: 875513 - protein, 211 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAK

SEQ ID NO: 875514 - protein, 330 aa, Homo sapiens
AKGQRREERAGRRRTAERQGARARPLVAGGEGSRGGRAARPLPWGEASLFSCCVVAMQLVAGSDASAITRTSFSTGVAARASHPHTPSQSVRRLISRPDARRGATGAQPVSCAALANQSQLVITLLRLILRHRSIGLLFVCIKVNFEPGMAEPRQEFEVMEDHAGTYGLGDRKDQGGYTMHQDQEGDTDAGLKAEEAGIGDTPSLEDEAAGHVTQARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPA

SEQ ID NO: 875515 - protein, 207 aa, Homo sapiens
APLYPVQSCWSSTDPQQPRAHSRGVEVPRLPLGYMNKTGAKLRPWPRLRFAQEGPERLEGPAPHNHPKPLWTLEKPIGQSGFSGSQDRATSRGGPQYLGHQAQYLSPNNNEQIAQALLSLGGPGTVTWEETCKTETEEAGIGDTPSLEDEAAGHVTQARMVSKSKDGTGSDDKKAKGADGKTKIATPRGAAPPGQKGQANATRIPAK

SEQ ID NO: 875516 - protein, 80 aa, Homo sapiens
PSVPAEEVQQPEMAAVLNAERLEVSVDGLTLSPDPEERPGAEGAPLLPPPLPPPSPPGSGRGPGASGEQPEPGEAAAGGA

SEQ ID NO: 875517 - protein, 123 aa, Homo sapiens
TPLLISGGRTVSELFVSISHLSLVVKDWLMITMHRKTFRRKGECFVDHFGFLFCVWQNSRGGEGWNKIGQWPLCLLAPQPQAASLWEPGNIHTARTWLFPQSDTTGQPGSPLLLKNALPCSSH

SEQ ID NO: 875518 - protein, 37 aa, Homo sapiens
MAARTRHDRTDHTQHEPRTRTHELRAHEHPTHRTTTV

SEQ ID NO: 875519 - protein, 93 aa, Homo sapiens
LKFFAALHMACRVTLWHCLFWGVLKKFYPVGKFRNAAFTNNENLPYIESRAGWTWWLMPVIPAFWEAEADGSLEARSSRPTWPLAIMVKPCLY

SEQ ID NO: 875520 - protein, 142 aa, Homo sapiens
SPGDTHQSSRDSVHLAIRGHSASSPRTTDPCTATTPGPPDTLPYPVPVPSSPASTKGFLGPTPGHCADTSGGGGGVGQKFCSCWPWGKDAGRSSCCPLTSPSGRLTGAEWAPVAPPGQGTGSLPIPATHSLTRASPVVSPSS

SEQ ID NO: 875521 - protein, 105 aa, Homo sapiens
FPFTLRQPTSVTLIKIIQYLSNWSLCLLSSLSLSNTPVPIHKLIYYSKTLTFVIIMALILLFFCLRNKRLPLQQILFVTFPHICNITYLFLSILFVTIPCIHSLF

SEQ ID NO: 875522 - protein, 144 aa, Homo sapiens
YIQSDRKWVAWCGPFLSSLFSLLSPTDILCPTTLSHFSSFLNLSKCLLARVPLLGMPSCPLSPATCKLFTFCGIHLNRIDHSFLVLSLYLLHILMSVLVTPNCSYLFPCHSLLLGCELLENRDCVCFIFMKSKNFMRNLTLSRK

SEQ ID NO: 875523 - protein, 67 aa, Homo sapiens
ASAVRERRSNVAPRGTGSIGPGEPILLPPSRPPSKAPRTHGSPKEGWPQAGVTQKRYKTKCQNPPNV

SEQ ID NO: 875524 - protein, 146 aa, Homo sapiens
THHHTHMSPPHTHHIPYTHNIPHTQHHTYHTHTCTHTTHTTYTSHHIYYTHKHTTYYTHHTHTTSPTIRTCHHHTHTHTHTPHTHTQVPHHKLWGKFLAFLLGERAVPREDWLISELEGLCGTGQPLQLSGTATQWVVRGFIRCTR

SEQ ID NO: 875525 - protein, 119 aa, Homo sapiens
LCGGQRSQAAQIQGVVSSQSVPIDHSSLRMLRLCFQVYLLFRFSCEISCIEIFSQMCKEPFKCIKRPGAVADTVIQTLWEAKVGGSHEARSSRPAQPTWQNPISTKNTKEFARHGGTHL

SEQ ID NO: 875526 - protein, 106 aa, Homo sapiens
MTGIPIRVTLGIQSETNLDIKTLHKVKPGDNNKGQYSHKQPTIQNDRIINEAARGGSHPKKARHRDCRNPVKHQDKRGNHGLPTGDLLTRMVARGTRPTYYSLHIG

SEQ ID NO: 875527 - protein, 155 aa, Homo sapiens
LNPGLSDFELLILVSLDVLREVVAAHEALAALGTGKALLARVSPQVPLQLVRAREALPAEEPVAHEGSLARVPAQVRLQVRRLPVHLAAARHVAHVLLLLPRLRLGGAARRLAVGTAAAAAPPGRGRQGGLGLQQRGDLALVLRKVRRAQHQASL

SEQ ID NO: 875528 - protein, 251 aa, Homo sapiens
AQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQHFLRQQEFLYLQQQAA

SEQ ID NO: 875529 - protein, 111 aa, Homo sapiens
SALYPRHLENTWHIEAVQKLFQEWMNKMTWAVSLILLLICCVTRTNANPYLFWNSMVLLYGTRGLGLSLKIYPALESTKYSGERVMPGVFDDSICPGYVVWQVNLKPLAWK

SEQ ID NO: 875530 - protein, 69 aa, Homo sapiens
CHRVFPHAVGWNKWFNPISFITKDEEGASYKELAFTSATQEGFLGEGRWLPYWRKKTRSNEVKQATRLE

SEQ ID NO: 875531 - protein, 76 aa, Homo sapiens
NNMAIGLWNSVLVVRMVQHPISNSFPEIVVITPSKRNYNQTKEPMWLLFERSPESDSSGLGHSSGYRTLSTVTRTV

SEQ ID NO: 875532 - protein, 119 aa, Homo sapiens
MCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIH

SEQ ID NO: 875533 - protein, 564 aa, Homo sapiens
LGAQPLWPCDLQVLGDPQLKTPGPPGSLEMGPLTIRDVTVEFSLEEWHCLDTAQQNLYRDVMLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 875534 - protein, 503 aa, Homo sapiens
MLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 875535 - protein, 136 aa, Homo sapiens
MQPLHWRRIFICQVAGPLASLILLNPARTYLQGAHFPRRASLEGGASQNAEDSGLLRLRSDAPQPWDQCPSPACQFPFSLHHEHKFGWELSLFIHFILSSHSVPGPDLCTAKRAGNSKTLSSHRGPWRMNAGGGHG

SEQ ID NO: 875536 - protein, 69 aa, Homo sapiens
MGMALELYWLCGFRSYWPLGTNAENEGNRKENRRQMQSRNERGCNVRQTKTYRDREADRHIHGIACLLF

SEQ ID NO: 875537 - protein, 129 aa, Homo sapiens
LPTGWGHKRRTIPAWVPASRPSELAVIGGGRSGWTGSAKLLRSPQDLRPAATEGTCSQGGEAAGAQAGLDVERRVSSIGAAVGPILAGQRAREGWGKARESPGGVPPFAGWSLAPVPRSHSSPVEPTRG

SEQ ID NO: 875538 - protein, 101 aa, Homo sapiens
ENKIILFFIEGFTNLRVILARGQCQSLSSSNFSICAAKVSTKTNFIKEVKTRFLLFVFFLLSLLQLSHRLCCAFGPEQKNLRLTQHAYNQHLCGGIPSSTL

SEQ ID NO: 875539 - protein, 114 aa, Homo sapiens
RPCRGLPPRCLPPFPAPLHRGLPSSPLTSGQQQSPTGRGGAGSLHLTPLLPPQATQKVGVEDSSAAAWRLTEQGTVPHTLGASGAGCHVASASRKSERTLWPLEQSWSFFGFFP

SEQ ID NO: 875540 - protein, 96 aa, Homo sapiens
VLTTRRPPRCNTPPSATAWTMMPVQRPSRDNDAQGNSLEPQLSPSTSKTLRECMLPGVQGKWCGLFIHQQENVTCIHWMQQQRQKASLKILNLPFH

SEQ ID NO: 875541 - protein, 376 aa, Homo sapiens
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVLVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 875542 - protein, 109 aa, Homo sapiens
LRPDPTVSAQCCFCHCLKQGVVRQAEKSILSLLENSFKKALIHCCSSPVHTGTCEALGVRGKNKEGETPQRRRLFLLEEVGELSLCPLYATRSKRKEHPFNPYSRSWVE

SEQ ID NO: 875543 - protein, 136 aa, Homo sapiens
MDYRLKCKTQNLKILEENLGSTMQDIGIGKDFMMKTPKAIATKANMDKWDLIILKSFCTAKETNRANRQPTEWEKIFAICASEKGLKSSIYKELNKFKRKKKQPIKRWAKDMNRHFSKEDIHGANEHIILYIHCWI

SEQ ID NO: 875544 - protein, 149 aa, Homo sapiens
DIEDVTPVFPQLSRSIISKLLNESETKVQKTEVEDADMLESEECEASKGYYLTKALTGHNMSEALVTEAENMKCLQFSKDVIISDTKDYFMSKTLGIGRLKRPSFLDDPLYGISVSLSSEDQHLKLSSPENTIADEQETKDAAEECKEP

SEQ ID NO: 875545 - protein, 166 aa, Homo sapiens
PCGWLSLENFPCIPGGTCPCLSIPCKRSRSRGLQAFTPRFTCVFPCPSCLCRCRCRHLKRRIFPTPLGAPPLPLHPFRADPPGSAPGSSALSFPPDKSWGGGARRRATSHFCQRRETRVRGAPIRGLCKSTELRNKAASARRDAAPTEPPSAPALAVPAQPPASGR

SEQ ID NO: 875546 - protein, 107 aa, Homo sapiens
MAGEQQSSSLGPGLTNQCPCPEVLGSALLLSSGAGHMATWEGLGRRHIPSVTKSSGAQVPFWAPLRVFGKVQNELGWWRIQEVWPVPPCALRSRGHWREGWVARRST

SEQ ID NO: 875547 - protein, 152 aa, Homo sapiens
MGNLCGCIQGDSKKPSKKHVKRKPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESTPHEDTVHDITNEDATHDIANEDTVHDIANEA

SEQ ID NO: 875548 - protein, 109 aa, Homo sapiens
MLSVSLVFRGAHIDVRNKKGNTPLWLAANGGHLDVVQLLVQAGADVDAADNRKITPLMAAFRKGHVKVVRYLVKEVNQFPSDSECMRYIATITDKVICCSLYEQGTLFG

SEQ ID NO: 875549 - protein, 1408 aa, Homo sapiens
MEAYVLEDILEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLRCLKLCLWRQVPCLQGPSQILQNPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPETVPGESKS

SEQ ID NO: 875550 - protein, 1354 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPETVPGESKS

SEQ ID NO: 875551 - protein, 1458 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKGKKVGGWLWLRKEKKEKRREGRKRKNKEGN

SEQ ID NO: 875552 - protein, 307 aa, Homo sapiens
VDSEIPQVADILCSSGCGTWRFCQDFRLIFNFKAFLFLELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPETVPGESKS

SEQ ID NO: 875553 - protein, 1605 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPETVPGESKS

SEQ ID NO: 875554 - protein, 1528 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLRCLKLCLWRQVPCLQGPSQILQNPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPETVPGESKS

SEQ ID NO: 875555 - protein, 1442 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKVICCSLYEQGTLFG

SEQ ID NO: 875556 - protein, 727 aa, Homo sapiens
MCGFQPDTVFSPQLRILLACVDKHFVGSVFQGTICDNTPGSWDISRDPNSSFYFTSLSYLYTNVVPLFALLPAGTDSNGFPSPWALVGAFVWLSFEILKDAVKGWAWLPSPNRCSGPVYVELGSCPPPTSVLLCSPSLTLSKYSKASALVSEACPLAFPLIPVAGFAFSGHQYIVGHETPLQKLHFLPLVACLHLSSVSPCFITSYTCPSRDRQPGLGSPGSPLGPSNSNSTGNSWDLLSTDSAAGSVELSMPVPSYHPHSPSMRWVQLFSDEKMAQEAGEVTVRNECWQLSPWTHRSAGPCSTGITLVRHLFMRPPRVWWSFVSFHLLPSTSWVIRAGEPRPHTVLLPDARHSLTPQQGLQSPKQMSLGVEAAGPPIPGVYCFALVIHPHCNLPSCHPNSAFGSLTPPRLAQSRAWRGLTGHSPCVLLPVSLHRDFFECLFFRPLAYIFSRLLIKYLKIIHKEPRNCLENQFLSSVVSNYMSSCCKKFPFFNAGASCGGFHGFPRPRPPGLGWLLAAHPRAPPGAVSVRVSGWSLKFLFLLGAFLLNKNDIVTKKSTAIEIWKVKASLPDLQSHLLEVNVVPSFICSFILLFIGKYFLSIFDSPGMMLGSEHTAVNNTATSSLCLLDILVRFNRSKAGLLDSFELQKWLRLAENPLRRCPTGLNKSSKNLNQDSNFRNERMRGALYGFLKECCNPTACVSYVLIQSDFITLFAFLFFTNLINNYWL

SEQ ID NO: 875557 - protein, 74 aa, Homo sapiens
HEIPFMLIRVIGNLSSSASREPNLTQVLRLGNGISISSSLQYSQSRKGKRKGVLVPGDVKVGSSYCCASKSHVD

SEQ ID NO: 875558 - protein, 68 aa, Homo sapiens
HYSDIHTTEDVSDELGNLDDIRQMSGLSVHPPAGGKSTKNSIGIFRIFTGSRKNTKETYYQKHWCKLF

SEQ ID NO: 875559 - protein, 71 aa, Homo sapiens
TDPVLTCITPMMASQRGFRSPVGLPHQRGLLTSRATNVDTIPSGTTYFCIPSTVLRSQGGPSKLWNNQTRD

SEQ ID NO: 875560 - protein, 109 aa, Homo sapiens
MERLCLQPGLLPTAVYLPHWERSSRDREEKEAPFFRLLSRRLMFCVHARQRTQNVPINKYQRLVVKMKEEEALREKLNMQNITHKENQNAGSLEMIDNMLKQEERRELK

SEQ ID NO: 875561 - protein, 226 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEYWRVSWEGHKGFGFQGNTFLSMGLLVPFLPLGFPSEVWPSFGRGKQRGGSTGGERRPS

SEQ ID NO: 875562 - protein, 206 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGKQRVLLGIQQLITYVLEHAILTLLNYYY

SEQ ID NO: 875563 - protein, 210 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGKQRVLLGIQQLITYVFRACNLNFVKLLLLITF

SEQ ID NO: 875564 - protein, 109 aa, Homo sapiens
ERCPFGQAGGLMGVPGEGVWLPAQDASQPCQGPVQRAGPHLCCSGRVVAARSVVLPCLGARFHSAHEYAVWEAPLLSLGRTNVAPLLMPDFSCWCSDGARGLGNLELAC

SEQ ID NO: 875565 - protein, 124 aa, Homo sapiens
MDSRAGGRPFGVFWGEGRGKEGSWTPGRALSNLSRWPSLLFPPNPSPLPSSSLPPPTRERWVACCLGQGAGVGVAEVGGMFSSAEHSSFGPGPVPRGKINSGQRLFSVGLHFRSPRTLCILDVG

SEQ ID NO: 875566 - protein, 48 aa, Homo sapiens
MTPSHSSLGARSEWRSRHCTPTQEAELAVSGDHAIALQPGRQGETGVS

SEQ ID NO: 875567 - protein, 165 aa, Homo sapiens
MQRCGYSRCLTYVPPAVHRRPLTLGLHGAESGTPLPQAPQSPRGLGAFSEATRRTSVPGGGWFSPLSRGPPSVAAGCSGGERYPQLAPGVPGGRIGVCRGPCDQEATVPSAAAPRPPRPQATRGNLAATPVPQVSLAGRAVPTGQGRQRAAACSAPADSAPAAPS

SEQ ID NO: 875568 - protein, 111 aa, Homo sapiens
MSAVMGKAESFCKYFSSFFGSVLVARRTCSFPTARSVVDPAAISPELCRRRCPRGRGSVRARGGGTGSLGWPVLAARSPGGDLGMWSHSLERAGSSEQRATWSGTPVLADS

SEQ ID NO: 875569 - protein, 123 aa, Homo sapiens
VSLEQNIPWSIRQVYQTQRRSTFNSLCPEPMSSFPKTRSSCAPSCMMKGITDSTLPKRQPEHHPEPHSPASSPFTNLTSCTSCLLLAKSSAPKMKGYQGPPVPTPEGRMKPTLFLCLTFSMVQ

SEQ ID NO: 875570 - protein, 188 aa, Homo sapiens
PDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQARYFKAY

SEQ ID NO: 875571 - protein, 339 aa, Homo sapiens
PDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVR

SEQ ID NO: 875572 - protein, 75 aa, Homo sapiens
RSPARVPTRGVKGQRMKKLRLKEVHQIESEVGETAFNAYILMICVRAAGQAIQRKRWNYQDGIKDASKQRGYLKP

SEQ ID NO: 875573 - protein, 114 aa, Homo sapiens
HFNIQVDHGMLWAPVLYKDVGQELPVVSTAPSHIALLMETFTPDVLSRLMGRIQMKKLRLKEVHQIESEVGETAFNAYILMICVRAAGQAIQRKRWNYQDGIKDASKQRGYLKP

SEQ ID NO: 875574 - protein, 149 aa, Homo sapiens
MLLFDLAVAKPNPQGHPSWLAKQWFLSLLFFFYYALQKLYYNGNRSRFTTCISFQELVSTLGLRFCRIPLFGWELSPSFLSKHMAFFSVGTGWIGMDRGHYSQAGYSRQKEVGHVLERPKLQRVHFSRGGVCKIVRGHKGNSPQVLAKE

SEQ ID NO: 875575 - protein, 127 aa, Homo sapiens
MPPCKVPRENTCKLPISSELCSLPFTNLLKHSFVLYWILLKQHLGLRLFSRSFRWQWPSQAVNPGCVIPQLTLWPVCLLIVETWCFLILSCSRMEVHCLASVPRWRWAIYFTRFFSGLPAGSRASGR

SEQ ID NO: 875576 - protein, 124 aa, Homo sapiens
VTGRGVFHKSLARSSTRAAAGPQALRPFSRSSQADAPVSAPPSSAPTEALARERIAGPRWLSHIPGAPPPRTPRPRPPASPADPAALNADAQPLFFHSRPLPHSHGNPRCFPKLGAFSEFKIQA

SEQ ID NO: 875577 - protein, 165 aa, Homo sapiens
SQLNAPTGLSPVSIQSVEIKDSSFLLISILVSILNLETSCFYDISHLIFFIFYLRNMKKKYTKMVKLLHKSAPAQSDSCKCPFICCVCISRISVGSRSGYQYIMHRSVGCLKAKQENHMNPGSGGCNEPKSCHCILAWAQSKTPSQKTKWSSKVAHACNPSTLGG

SEQ ID NO: 875578 - protein, 35 aa, Homo sapiens
MERIQSLCAWIFRARYLPVGIPRSQGLGSESETFD

SEQ ID NO: 875579 - protein, 390 aa, Homo sapiens
SGGGVVSLVRMLSPRCGLAVVFFFFPRAARRLRTGCGMGSEAPASGCSGAVGSSQREAAASLVSSWEEQNRGGAPAGAGGGPTMAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVTKGRSSKKKEQKNWVLKWNIKLPNCLAESPRNKKEKSS

SEQ ID NO: 875580 - protein, 426 aa, Homo sapiens
SGGGVVSLVRMLSPRCGLAVVFFFFPRAARRLRTGCGMGSEAPASGCSGAVGSSQREAAASLVSSWEEQNRGGAPAGAGGGPTMAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLGIHLRYSGIYDVEISLIFTFERRKENFCFSGTKLLKEETNSY

SEQ ID NO: 875581 - protein, 367 aa, Homo sapiens
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASPLSWTPVPPGPWVPGHWLPPGFSMPPPVVCRLLYQEPAVSLPPFPGFDPGTSLQLPTHGPFTTCPGSHPVLTAPLSGEPQGPPSQPRTHSTLILQPCGTPDPLQLQPQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 875582 - protein, 157 aa, Homo sapiens
GTRSYENRCPLLARDPLCSRSHPVLTAPLSGEPQGPPSQPRTHSTLILQPCGTPDPLQLQPQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 875583 - protein, 114 aa, Homo sapiens
TPVEIASVFPSDLEAKSICWQAFIEHLLLCARGWGAQDEPGIGPAFNQPGPYAALAWHSHFHLLLLPATPTHHCLKQPTSTAGCLHCCFRVCWPVGPVCVVSWPRQELVLSSVP

SEQ ID NO: 875584 - protein, 86 aa, Homo sapiens
HTLGSSPEPRPGCSSFPCPVTHCVWLLDNQGELGRSFWTYSEQVDAGVPTAQKEKAKQNNAVFGPLLSFHHSIPHRHFSMVSLYAV

SEQ ID NO: 875585 - protein, 193 aa, Homo sapiens
MGVLIGRGHLATGGCEGRTSCERVDLHAEEGPGTDPSFTASEGTNLLAPRSQIPASRTGRQGVSVVEATQAVALCYGSPSERIQSLLFPREAELNELPQEIFLQYLGRVCVCVDRAVCRRTSMRRWQAPPVSPFRHPGKEADASQLFRVQAWLSRGFRPEGGRWLKLVLGLFEPLKELSGCIRNHPCAAGSSC

SEQ ID NO: 875586 - protein, 188 aa, Homo sapiens
MAHALVTFRDVAIDFSQKEWECLDTTQRKLYRDVMLENYNNLVSLGYSGSKPDVITLLEQGKEPCVVARDVTGRQCPGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHD

SEQ ID NO: 875587 - protein, 101 aa, Homo sapiens
QAILPPRPPKVLGLQARATMPGQDSPFFLDNAWTHEAHRHPPSRVLGRHTCRWAHLAKVRQLGQHLTSVRLISSLGALQEPAVNWALKHPVCAFPGRFCDS

SEQ ID NO: 875588 - protein, 98 aa, Homo sapiens
RYLNLSPERMYSMLMSSFSPVVRNPVDCSVLTALSVPCLTLAHGSGAGSALLLLPITRGRNPLPAEGRGPQLLQPLVYPCSVDPYFWSCIQEQDHADN

SEQ ID NO: 875589 - protein, 122 aa, Homo sapiens
MDASHTTSSGSLFPLGHKHEGERKKTIIPREQVKEQSSTTRLNLSCLMNLYCSQFSCTQILQGHMEWWLPMEVARPQRCPPQLHLLPGDLHRCSLTLRGGRASAVSQLTLIQQLRYNCYVFI

SEQ ID NO: 875590 - protein, 79 aa, Homo sapiens
DMWNSTPKAAACGGALSSQAASWRSWHTCCRLRSSVGNASCGPSPPLEETRCSPQPPFIILIHRLRNVRSVSAPERLSD

SEQ ID NO: 875591 - protein, 123 aa, Homo sapiens
TGGRQLMRTTCVPWSCPTPVSLVFVVLLGNIFICKNGCFCTWLWLRASAHVKSFTSHLEEKRNTGKTLVIYCSQPRPSQNAVHCVHGVHGPSWKLAHSEIILSFLISKISKAFLRHILVLPLS

SEQ ID NO: 875592 - protein, 65 aa, Homo sapiens
SSTSFLSHTYLINKTRSTTRKVEEHSWFTCTGAKYFAIPLAERNTKRLTKRSTHAQLLRGKQDGS

SEQ ID NO: 875593 - protein, 89 aa, Homo sapiens
RAAGGVLPVDLERERAALCARQSGHGPPAVRWLLGSRGAESGGLARRRVAAEHAQPSANLVCRSALETSAFPPSKPKSPRGRVRGRSLQ

SEQ ID NO: 875594 - protein, 157 aa, Homo sapiens
ANSMREVASPSPELEAGRSVYLKMSWHRTIVWVHTSVNCPKESLLSCIMVSVLEPRDSQYIADRHSQESYTLCSWNNEAGEDGALLRTTEGLQPASNATLISATSLLPPALRLASKEAPSARSCEAARECRQVGGAPQSWRGRESPQGFVRLGVIKG

SEQ ID NO: 875595 - protein, 180 aa, Homo sapiens
RAAGGVLPVDLERERAALCARQSGHGPPAVRWLLGSRGAESGGLARRRVAAEHAQPSANLVCRSALETSAFPPSKPKSPRGRVRARSSDGRLRHPAWRAGSGGRGGRGPSAELASGYWGRRRALPGAADLRPKGARADDRRPLRAGRKLHLPEAARLPGNVGKSGEPHKAGEVGNHPRDS

SEQ ID NO: 875596 - protein, 185 aa, Homo sapiens
MRHSVARPTRLPRRLSPFWDPATCKNLEGGAGEVVRGRDPRRRRTSRSTEILGEDLAGPSAGAAARPAAPPPQPREPGAPGLRRAPPRTRMDSSGLGPCSEAPLHTSAGLSGRDLRAAGGVLPVDLERERAALCARQSGHGPPAVRWLLGSRGAESGGLARRRVAAEHAQPSANLVCRSALETSA

SEQ ID NO: 875597 - protein, 101 aa, Homo sapiens
TLWPWASMRATELPKMGASLAQPPPKWATDQAHQVHVGHYSKDVWLYSLRAGAPWSCSRFPRTNGPQVHQEESGGHVRTKMKREELSNALPAMKKVATKKD

SEQ ID NO: 875598 - protein, 118 aa, Homo sapiens
MVSTLDSEFSDQSSSLTGTFLYNSSEVPLYCSISRMGEIAQSWSQTLHATGCMQLESRTQRPARPLPSQGDPGPPGHRSPLKMLPPLNPRPRVFFCSRHWAIALCLFGRNDLYEKFYF

SEQ ID NO: 875599 - protein, 133 aa, Homo sapiens
DTLELQFLRLQNGILRDTHLALSQWVAVGAVGTAASTFLIWQTMLCATHRLLIWTRDNGAPSRPHSEPGHVTFSPTDLAQKRCATSSPRQRVLPDPSLFSGCSYSEASDSGLRQPGFLHWLGGGPSRGPFIRL

SEQ ID NO: 875600 - protein, 70 aa, Homo sapiens
GGFSPKPPSLVWPRKRAFKGYYSNYIGDRRDPRGYVTGKPFDSCSLISASSTGTIAETYGDKSEDSVSGI

SEQ ID NO: 875601 - protein, 418 aa, Homo sapiens
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 875602 - protein, 272 aa, Homo sapiens
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 875603 - protein, 164 aa, Homo sapiens
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITCKYNFS

SEQ ID NO: 875604 - protein, 115 aa, Homo sapiens
RFLHFLSTPPKDCPSLPALDTNIISTSFSVLHNWSQPYFLFHTTDKCSKLQAAGAGAQHRRVALTGLRATQQASSSQSGLYTATTRELSKRTNNESPYQRFDGIDIEFDLGVRFF

SEQ ID NO: 875605 - protein, 48 aa, Homo sapiens
GVVLGKTSPFPGRGQAKLGLILDQCLLANTYATLKPSGFAISTLGALS

SEQ ID NO: 875606 - protein, 111 aa, Homo sapiens
KGATEAGRSESPFLSDLPSRKQQPSRSQQSPEAVIQLPLGQVQRAVIILSELHPNAHTPNLVLPRDNTSSRSSPVSSCTNRWCLRTACHREPSDQPCQPGAKGADKGSLSQ

SEQ ID NO: 875607 - protein, 102 aa, Homo sapiens
ELPSVCWNVMAVRRREEKWKRSVFIDPTEPCKKAPTTYMQSVHFKSNKQTKSVYQLLGEKMDYHSLQILLGKQKSATPVQREKFYICSTMGPQYNTVPSCIS

SEQ ID NO: 875608 - protein, 102 aa, Homo sapiens; identical to SEQ ID NO: 875607

SEQ ID NO: 875609 - protein, 127 aa, Homo sapiens
MGEGLVCLGYQGPLFIGRCLLFLCVAAFVSQDCHNKFITNLVAQHSTALFPSWDWAIIDSPIPGPQHSPGSWSFPLSPRIDILKDSALIPQLFHPSVLSSSAKAVIPGASCYLPQLRKEFPALSLLP

SEQ ID NO: 875610 - protein, 177 aa, Homo sapiens
VKLADFKNEAAGLTVSVTALFRNEAADTRSLRIHVKFLSWDFVVQIISSLRCKDDLSRNFHTAQVCTTELKSLKCREYILDLRVPLSSVFSKKAVSAMGSVVLASGYSPVLELINDLLYISYLIPETAKNKIRSSKTGIKGFIVPTASGYSPALELIKDLVYISYLTPETVKNKINK

SEQ ID NO: 875611 - protein, 770 aa, Homo sapiens
MLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 875612 - protein, 761 aa, Homo sapiens
MLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKANIESKRPKAKSVKKQKK

SEQ ID NO: 875613 - protein, 131 aa, Homo sapiens
LLLPRVSERAFRHLHAHWGVPSFILGLLAHCLGATGGGSFYRPLSEHSLGSLRPKTEEKILASENPWAKGPSGVMRGAGSRSQALTTRFSCRSAGKPCAWSPPRRTIDMKTKVRGSGRMVWVSGSPRPCPL

SEQ ID NO: 875614 - protein, 30 aa, Homo sapiens
MAKPQGLVTFEDVAVDFTQEEWQYLNPPQR

SEQ ID NO: 875615 - protein, 26 aa, Homo sapiens
MHAHARARAHTHTHTHTHTHPSCGLV

SEQ ID NO: 875616 - protein, 103 aa, Homo sapiens
MPLVLLAIKSLCPWRLRKEPEVALSNMDRLLIFQGSSAPASVPSLLWAEGPGTQPQSSACFLQHAHLEIEISHIFTTQKPGCIFVLFKICQRNFSYPLNFLQK

SEQ ID NO: 875617 - protein, 92 aa, Homo sapiens [sequence omitted]

SEQ ID NO: 875618 - protein, 90 aa, Homo sapiens
GTISLFKMQPPEQSGFHMAALIPSCRWKVSSAILRVTPSIGSWDNFTQKGIITPNAYMCLFVKQELLKNSDGFNTIWHAARRGNLGSHQV

SEQ ID NO: 875619 - protein, 664 aa, Homo sapiens
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHCIGYPVVTLGLGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETIIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 875620 - protein, 487 aa, Homo sapiens
MRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETIIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 875621 - protein, 437 aa, Homo sapiens
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHWLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETIIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 875622 - protein, 930 aa, Homo sapiens
FKIINNRRYVYFICKENMAALFLRGFVQIGNCKTGISKSKEAFIEAVERKKKDRLVLYFKSGKYSTFRLSDNIQNVVLKSYRGNQNHLHLTLQNNNGLFIEGLSSTDAEQLKIFLDRVHQNEVQPPVRPGKGGSVFSSTTQKEINKTSFHKVDEKSSSKSFEIAKGSGTGVLQRMPLLTSKLTLTCGELSENQHKKRKRMLSSSSEMNEEFLKENNSVEYKKSKADCSRCVSYNREKQLKLKELEENKKLECESSCIMNATGNPYLDDIGLLQALTEKMVLVFLLQQGYSDGYTKWDKLKLFFELFPEKICHGLPNLGNTCYMNAVLQSLLSIPSFADDLLNQSFPWGKIPLNALTMCLARLLFFKDTYNIEIKEMLLLNLKKAISAAAEIFHGNAQNDAHEFLAHCLDQLKDNMEKLNTIWKPKSEFGEDNFPKQVFADDPDTSGFSCPVITNFELELLHSIACKACGQVILKTELNNYLSINLPQRIKAHPSSIQSTFDLFFGAEELEYKCAKCEHKTSVGVHSFSRLPRILIVHLKRYSLNEFCALKKNDQEVIISKYLKVSSHCNEGTRPPLPLSEDGEITDFQLLKVIRKMTSGNISVSWPATKESKDILAPHIGSDKESEQKKGQTVFKGASRRQQQKYLGKNSKPNELESVYSGDRAFIEKEPLAHLMTYLEDTSLCQFHKAGGKPASSPGTPLSKVDFQTVPENPKRKKYVKTSKFVAFDRIINPTKDLYEDKNIRIPERFQKVSEQTQQCDGMRICEQAPQQALPQSFPKPGTQGHTKNLLRPTKLNLQKSNRNSLLALGSNKNPRNKDILDKIKSKAKETKRNDDKGDHTYRLISVVSHLGKTLKSGHYICDAYDFEKQIWFTYDDMRVLGIQEAQMQEDRRCTGYIFFYMHNEIFEEMLKREENAQLNSKEVEETLQKE

SEQ ID NO: 875623 - protein, 68 aa, Homo sapiens
AVSPGWGAAGAADEAPESTPRNGQALIAQPELVTVLLCTPASSHKNKEHTKNHTPVIPHQMSPPILSY

SEQ ID NO: 875624 - protein, 99 aa, Homo sapiens
LRYKITVFKQCEATPPPRLKSTSPLRLVPRRYPRTQASSTKRTQQRHFCKNYACISVSASEQLSRLILKPTHSTLEGFDLGHRPGKSRAHMRWDTAITA

SEQ ID NO: 875625 - protein, 105 aa, Homo sapiens
GLSRRSDEKRGCPAPPETTGHAATCQAPPFLPGEGQVFHTDSRDFKDQGFEEVLALPRKGGSFWKRRERRQTLRWDQQSLRSCGKLTEPSQRSGKEPQPQAGTVF

SEQ ID NO: 875626 - protein, 105 aa, Homo sapiens; identical to SEQ ID NO: 875625

SEQ ID NO: 875627 - protein, 156 aa, Homo sapiens
RGPAPPSPLKETSFSIGLQVLFPFLLAGFGTVAAGMVLDIVQHWEVFQKVTEVFILVPALLGLKGNLEMTLASRLSTAANIGHMDTPKELWRMITGNMALIQVQATVVGFLASIAAVVFGWIPDGHFSIPHAFLLCASSVATAFIASLVLGKKGRA

SEQ ID NO: 875628 - protein, 123 aa, Homo sapiens
SPGIACSPTVVLCPGHSEDSLLLEGYQSPVGSATCAESSPDKSALVQRRLVACGTSEDRGASWGLSSSTNKAGPLPAGSHMAFSSRAPWRKPSCVPTTENLAQARKVLGLLNKIAMFVNKIIL

SEQ ID NO: 875629 - protein, 540 aa, Homo sapiens
AAKLQIGELSGKVKKLQYENRVLLSNLQRCDLASCQSTRPMLETDAEAGDSAQCVPAPLGETHESHAVRLCRAREAEVLPGLREQAALVSKAIDVLVADANGFTAGLRLCLDNECADFRLHEAPDNSEGPRDTKLIHAILVRLSVLQQELNAFTRKADAVLGCSVKEQQESFSSLPPLGSQGLSKEILLAKDLGSDFQPPDFRDLPEWEPRIREAFRTGDLDSKPDPSRSFRPYRAEDNDSYASEIKELQLVLAEAHDSLRGLQEQLSQERQLRKEEADNFNQKMVQLKEDQQRALLRREFELQSLSLQRRLEQKFWSQEKNMLVQESQQFKHNFLLLFMKLRWFLKRWRQGKVLPSEGDDFLEVNSMKELYLLMEEEEINAQHSDNKACTGDSWTQNTPNEYIKTLADMKVTLKELCWLLRDERRGLTELQQQFAKAKATWETERAELKGHTSQMELKTGKGAGERAGPDWKAALQREREEQQHLLAESYSAVMELTRQLQISERNWSQEKLQLVERLQGEKQQVEQQVKELQNRLSQV

SEQ ID NO: 875630 - protein, 81 aa, Homo sapiens
SCCRVAACAPYITPIFQVGTVPGGCSAPCRLLLAGTFARGHVSSKEDADILLAGTFARVHVSCEGHADILLAGTSTGSHVS

SEQ ID NO: 875631 - protein, 87 aa, Homo sapiens
DRVLFDSHQQRLMAPQVVPVCCLPALRQVGGVQHRAQAPGPQCLRRASSGCGGGGVAVCLGLWLCPDHPLTGLCPLLEVKGTLVPGS

SEQ ID NO: 875632 - protein, 104 aa, Homo sapiens
LPCHLPVLARVTATTENLILSLFCQSCPTSNLRKEAQALDRALGPSLAGGFCLIPLVAPPLSVSVSDGATNRNVHLFTGYIFLFTSYICALLNSLYVYNKKFKT

SEQ ID NO: 875633 - protein, 611 aa, Homo sapiens
MQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 875634 - protein, 649 aa, Homo sapiens
ASFQIFSASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 875635 - protein, 643 aa, Homo sapiens
MASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 875636 - protein, 643 aa, Homo sapiens; identical to SEQ ID NO: 875635

SEQ ID NO: 875637 - protein, 450 aa, Homo sapiens
MGLRSHHLSLGLLLLFLLPAECLGAEGRLALKLFRDLFANYTSALRPVADTDQTLNVTLEVTLSQIIDMDERNQVLTLYLWIRQEWTDAYLRWDPNAYGGLDAIRIPSSLVWRPDIVLYNKADAQPPGSASTNVVLRHDGAVRWDAPAITRSSCRVDVAAFPFDAQHCGLTFGSWTHGGHQLDVRPRGAAASLADFVENVEWRVLGMPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 875638 - protein, 126 aa, Homo sapiens
MPARRRVLTYGCCSEPYPDVTFTLLLRRRAAAYVCNLLLPCVLISLLAPLAFHLPADSGEKVSLGVTVLLALTVFQLLLAESMPPAESVPLIGGSGGAGGPDDALGSPQGGAATGPGSAERPHCRK

SEQ ID NO: 875639 - protein, 145 aa, Homo sapiens [sequence omitted]

SEQ ID NO: 875640 - protein, 155 aa, Homo sapiens
MGLRSHHLSLGLLLLFLLPAECLGAEGRLALKLFRDLFANYTSALRPVADTDQTLNVTLEVTLSQIIDMVRCGGGTAVESYLSQCQEMKEDERNQVLTLYLWIRQEWTDAYLRWDPNAYGGLDAIRIPSSLVWRPDIVLYNKYCLSGPLLSLTPL

SEQ ID NO: 875641 - protein, 244 aa, Homo sapiens
MPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 875642 - protein, 155 aa, Homo sapiens; identical to SEQ ID NO: 875640

SEQ ID NO: 875643 - protein, 72 aa, Homo sapiens
MFTIRGCGRKGYQDEDEEEEDGIDNKGSDTRTIGLTASSSPSCKEGAMYTNFSPPLFFCYVYLAMVDLTMTI

SEQ ID NO: 875644 - protein, 222 aa, Homo sapiens
MWDKGGPKKAKQVKTTKSTSATPETNNHVEDTAHKRQQRGATPEQQDTNTKRGEEHPHLRPKHTKQDNHKKHPQRRPHIQRKPRVTTTGLPTQQTHNKRHSTPQQTLEYNRTTYRQQTTNTQRGSTQGGQNNEREANTAATNTNTTTTTARNTTTRTENRTLTERQNATTAKEEASRRRGPHRTHKHKKQGRAGRRQTTQRTDRETNSETTTKEPDEKIKRQ

SEQ ID NO: 875645 - protein, 101 aa, Homo sapiens
GAGPSQLRLHYPRISMAVRQWVIALALAALLVVDREVPVAAGKLPFSRMPICEHMVESPTCSQMSNLVCGTDGLTYTNECQLCLARIKTKQDIQIMKDGKC

SEQ ID NO: 875646 - protein, 109 aa, Homo sapiens
MILGIGSSPHLLWTLEGTHIWSLLGDASHTDRLPEAGAGKLLSEVPVAAGKLPFSRMPICEHMVESPTCSQMSNLVCGTDGLTYTNECQLCLARIKTKQDIQIMKDGKC

SEQ ID NO: 875647 - protein, 94 aa, Homo sapiens
LLEVMGAERVCTKAPEITQDEAEIYSLTNMEGNIGIKGCEFKSWLFKFYQARSQVLLCGEVKNPYLLTSNKTTVKEQNACLTHPDRSAMAGLLL

SEQ ID NO: 875648 - protein, 119 aa, Homo sapiens
MALHRGGASFCCPSHLAGSFPPQGLCTGSFFLEGYLFRFSQEGFSLSFRSQVQCHLSESASPHVKCTSTDHASDPLHFLHVTQSYDLLLVCCLSLLIEQKPSEGRGLPVSQEPKSVYGT

SEQ ID NO: 875649 - protein, 138 aa, Homo sapiens
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPALKSAFPSWTPPDPTWSPPVLEPRGPTPRMLGSPP

SEQ ID NO: 875650 - protein, 138 aa, Homo sapiens; identical to SEQ ID NO: 875649

SEQ ID NO: 875651 - protein, 194 aa, Homo sapiens
IQGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDMNAHTHVQYTHTHTNSTYFLPTC

SEQ ID NO: 875652 - protein, 184 aa, Homo sapiens
IQGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 875653 - protein, 184 aa, Homo sapiens; identical to SEQ ID NO: 875652

SEQ ID NO: 875654 - protein, 184 aa, Homo sapiens; identical to SEQ ID NO: 875652

SEQ ID NO: 875655 - protein, 184 aa, Homo sapiens; identical to SEQ ID NO: 875652

SEQ ID NO: 875656 - protein, 297 aa, Homo sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHTLAKNPGTADHTHIPGRAVSRALPSSANLEMTCTPGGWQQPWYNLQVQFWPKLWILPLMSDIGELNVTDSSWTAAKLQPRPLKGGPKPGSGAQ

SEQ ID NO: 875657 - protein, 125 aa, Homo sapiens
KQIVHPDSEKRAAAASAISEGQLSSDESGDLTFSLKNLSKTPALQLVHELFMKSKRKRLQENSGHEFLEQGDGEKIAVLQCILAGLIGKKMGIEKLDILTELKYRNLKHILAMVLESLTAESLCR

SEQ ID NO: 875658 - protein, 124 aa, Homo sapiens
PALPDRRAGATRKARLIRTSSGVELGLKPSCPARPECPRPHRHPRGLDGAGDGRRRRGVEGERRRRREELTGNPQATRGKTLNLSRTFHACRNENDSCDKKKIHLGGIWNLVSLRREGGGETPC

SEQ ID NO: 875659 - protein, 102 aa, Homo sapiens
MVDEMWKESQCSATGDWLRHHATAMQGTDTRPFKTVTLLIESNPLSPLSQHHRSLSFVAFITIIILHFFVNFFDEFLSPSLDAKLCEGKDSITFIIVPSVLS

SEQ ID NO: 875660 - protein, 65 aa, Homo sapiens [sequence omitted]

SEQ ID NO: 875661 - protein, 124 aa, Homo sapiens
CSLLEAAGARLRLWLVHPMLDQVVPNPPGLSHIWGKICGLLDSISFGYVLCLWHYAGPLGNFFCSPYFLISRPVPCTARFPLKCHLEQQWPPDRPAKQQGSHSPEQAWWPSRCGQNKKTLSASE

SEQ ID NO: 875662 - protein, 506 aa, Homo sapiens
EFRAMSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 875663 - protein, 116 aa, Homo sapiens
LVDGKGHLRLTHLQEVLEGGGDVEVLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 875664 - protein, 119 aa, Homo sapiens
GHRPGSPPSELTHRTRLSPRKLPWALRSVPLPCSRPQATDDLLPVTGHAFAFSRIPRNGIRQRVLLMGWLLSLSIIKRGFLHVPRIRSSFLFPAESCSVVGKATVCLPTHLVMNVWVVP

SEQ ID NO: 875665 - protein, 78 aa, Homo sapiens
ALKASRLAENYISNEKFINNIIGLISSFLVRILWVASDSDPPHTVGSQNKGKEGQQSPGWGGLWPVCRTTGLSDLGIT

SEQ ID NO: 875666 - protein, 579 aa, Homo sapiens
MKDFSDVILCMEATESSKTEFCNPAFEPESGPPCPPPVFPEDASYSVPAPWHGRRPRGLRPDCRFSWLCVLLLSSLLLLLLGLLVAIILAQLQAAPPSGASHSPLPAGGLTTTTTTPTITTSQAAGTPKGQQESGVSPSPQSTCGGLLSGPRGFFSSPNYPDPYPPNTHCVWHIQVATDHAIQLKIEALSIESVASCLFDRLELSPEPEGPLLRVCGRVPPPTLNTNASHLLVVFVSDSSVEGFGFHAWYQAMAPGRGSCAHDEFRCDQLICLLPDSVCDGFANCADGSDETNCSAKFSGCGGNLTGLQGTFSTPSYLQQYPHQLLCTWHISVPAGHSIELQFHNFSLEAQDECKFDYVEVYETSSSGAFSLLGRFCGAEPPPHLVSSHHELAVLFRTDHGISSGGFSATYLAFNATENPCGPSELSCQAGGCKGVQWMCDMWRDCTDGSDDNCSGPLFPPPELACEPVQVEMCLGLSYNTTAFPNIWVGMITQEEVVEVLSGYKSLTSLPCYQHFRRLLCGLLVPRCTPLGSVLPPCRSVCQEAEHQCQSGLALLGTPWPFNCNRLPEAADLEACAQP

SEQ ID NO: 875667 - protein, 465 aa, Homo sapiens
AVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEKLLPAHALQENALALCQREVDGGDDGRRMLGRCCLPRDPQSPQHGCMGLVQVSTAVFRSFTRRLHFSWLAGKSDPRKSSLS

SEQ ID NO: 875668 - protein, 456 aa, Homo sapiens
AVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEKLLPAHALQENALALCQREVDGGDDGRRMLGRCCLPRDPQSPQHGCMGLVQVSTAVFRSFTRRLHFSWLGYI

SEQ ID NO: 875669 - protein, 32 aa, Homo sapiens
MAAKRAASFRQNSASERADSIEIYIPEAQTRL

SEQ ID NO: 875670 - protein, 538 aa, Homo sapiens
AVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 875671 - protein, 394 aa, Homo sapiens
AVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEESKSSGFPRAS

SEQ ID NO: 875672 - protein, 110 aa, Homo sapiens
RGERRKLKDLKDMSIIFSMQFLFEFDSHKQFKQYDNISVAIGDVNAGWIFDEILEHVKLTYSNGISVTLGDRDGVSRGRLTAKKHKGTFWVMNIFYVLIEVIVYILVKIH

SEQ ID NO: 875673 - protein, 545 aa, Homo sapiens
AEQLSPAPAGPEVSELPPAAGSDTGLPAGDCSMAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 875674 - protein, 500 aa, Homo sapiens
GKAEDASVCVSRVFGVRPLLTPAPPPAYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 875675 - protein, 102 aa, Homo sapiens
FFGFEIQVDTYLTQSLGHNMQNTRCLPRPGMGVQVCWSWKLEGQSWLMLSGDTRQGSRAETPALTPAVTGAPTKRDSKVPTSAVCYKDRAGWPGPCEHVVLV

SEQ ID NO: 875676 - protein, 102 aa, Homo sapiens
MGPRGEAPCLRAALVLEMNGKDPHNLVSGELPNLISVALSLSFRTSSCLRTILCWKALSHISLWPPSSLPSGLCFDVPFLGKSPLTRIFKLQPSTSTLHSIP

SEQ ID NO: 875677 - protein, 111 aa, Homo sapiens
SRHLSGARERGRAGRYSNRRNLDSLPRKPSTGFAALSRRVNQAISCLGTESALEKAEGPTLVTQERWQDFHPSHLTWNPWINQLPLEANPETKGAVYTETEKLAGHGGGRL

SEQ ID NO: 875678 - protein, 123 aa, Homo sapiens [sequence omitted]

SEQ ID NO: 875679 - protein, 97 aa, Homo sapiens
LIRTRSCENCLSRPSSTEATVRHMREKVNPDEAHQEQILWEPERTTPDEVHQNQILWELHFKVLQTHKHYMQHHMNALCKGEGPGRMEEIPERGDAP

SEQ ID NO: 875680 - protein, 108 aa, Homo sapiens
GIYPSPISVSRVSPQPPCRMPNGYTTREFFPPRGSLYYVHLWGTFRPYGIPQGPLIMDPLILGSPRLGETFLRPYSAAQELQCCPQGDTKGNAKLNVTRAPKNNWWDP

SEQ ID NO: 875681 - protein, 700 aa, Homo sapiens
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYNCEECGRAFIHASHLQEHQRIHTGEKPFKCDTCGKNFRRRSALNNHCMVHTGEKPYKCEDCGKCFTCSSNLRIHQRVHTGEKPYKCEECGKCFIQPSQFQAHRRIHTGEKPYVCKVCGKGFIYSSSFQAHQGVHTGEKPYKCNECGKSFRMKIHYQVHLVVHTGEKPYKCEVCGKAFRQSSYLKIHLKAHSVQKPFKCEECGQGFNQSSRLQIHQLIHTGEKPYKCEECGKGFSRRADLKIHCRIHTGEKPYNCEECGKVFSQASHLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNLVSHHKIHAAGTFYENDENSKNIRELSEGGSSTR

SEQ ID NO: 875682 - protein, 700 aa, Homo sapiens; identical to SEQ ID NO: 875681

SEQ ID NO: 875683 - protein, 267 aa, Homo sapiens
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYRTLQGAP

SEQ ID NO: 875684 - protein, 133 aa, Homo sapiens
CPECGKGFICRRDLYTHHMVHTGEKPYKCGECGKGFKWSLNLDMHQRVHTGEKPYTCGECGKHFKHRSYLMWHQQTHTGEKPYECSECGKVFLESAALIHHYVIHTGEKPYKCKECGKGFSQASNLQVHQNVH

SEQ ID NO: 875685 - protein, 675 aa, Homo sapiens
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYNCEECGRAFIHASHLQEHQRIHTGEKPFKCDTCGKNFRRRSALNNHCMVHTGEKPYKCEDCGKCFTCSSNLRIHQRVHTGEKPYKCEECGKCFIQPSQFQAHRRIHTGEKPYVCKVCGKGFIYSSSFQAHQGVHTGEKPYKCNECGKSFRMKIHYQVHLVVHTGEKPYKCEVCGKAFRQSSYLKIHLKAHSVQKPFKCEECGQGFNQSSRLQIHQLIHTGEKPYKCEECGKGFSRRADLKIHCRIHTGEKPYNCEECGKVFSQASHLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNQVTILLLSP

SEQ ID NO: 875686 - protein, 175 aa, Homo sapiens
HLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNLVSHHKIHAAGTFYENDENSKNIRELSEGGSSTR

SEQ ID NO: 875687 - protein, 81 aa, Homo sapiens [sequence omitted]

SEQ ID NO: 875688 - protein, 183 aa, Homo sapiens
MAYHGLTVPLIVMSVFWGFVGFLVPWFIPKGPNRGVIITMLVTCSVCCYLFWLIAILAQLNPFFGPFFMLFFFFFFVVPFEDMPFGCGTSGLLFLIFFSRPSLPSLPLPFLSSFFSFFTIIASPSFFSLVPPTAYPPPSLSPISTFFPITFPSSPLIPPPLSIPPPPTLPFYILLHALFFSLP

SEQ ID NO: 875689 - protein, 81 aa, Homo sapiens [sequence omitted]

SEQ ID NO: 875690 - protein, 81 aa, Homo sapiens [sequence omitted]

SEQ ID NO: 875691 - protein, 81 aa, Homo sapiens [sequence omitted]

SEQ ID NO: 875692 - protein, 81 aa, Homo sapiens [sequence omitted]

SEQ ID NO: 875693 - protein, 103 aa, Homo sapiens
VVLHETHVCLAWIPGPRVLTPTLRGGPGSTTSMWTGLRLRARVMHWAPMDQLRRARQTWSSRSTGNTDSGHPTPPPHLAPLEASSPKSSPSKACRPTVISALR

SEQ ID NO: 875694 - protein, 81 aa, Homo sapiens [sequence omitted]

SEQ ID NO: 875695 - protein, 81 aa, Homo sapiens [sequence omitted]

SEQ ID NO: 875696 - protein, 81 aa, Homo sapiens [sequence omitted]

SEQ ID NO: 875697 - protein, 107 aa, Homo sapiens
MQSLILYRHGILDQSVRMNMQRTDLGDDRAQQFVHQLQYLVSILLKFLKFKEAINKVINKRNNYIMPPTHQRELSGVTFFTASQVQAILVPQPLEELGLQVCVTTPG

SEQ ID NO: 875698 - protein, 197 aa, Homo sapiens
MTRFGVRLYKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLMEL

SEQ ID NO: 875699 - protein, 758 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875700 - protein, 462 aa, Homo sapiens
IAAAVPRVSVMVISRAIPVEQHSPLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875701 - protein, 758 aa, Homo sapiens; identical to SEQ ID NO: 875699

SEQ ID NO: 875702 - protein, 223 aa, Homo sapiens
DAWVDPRVRPRVRNDLWQILENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875703 - protein, 187 aa, Homo sapiens
GDQQDLRDTSVTLKVCAGYYTKGFALLNFVVKYSPERQRSLRPHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875704 - protein, 758 aa, Homo sapiens; identical to SEQ ID NO: 875699

SEQ ID NO: 875705 - protein, 423 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTVPTDLPPVVCTPPPELCSLRVLRPG

SEQ ID NO: 875706 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875707 - protein, 445 aa, Homo sapiens
SPVKHTPLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 875708 - protein, 758 aa, Homo sapiens; identical to SEQ ID NO: 875699

SEQ ID NO: 875709 - protein, 758 aa, Homo sapiens; identical to SEQ ID NO: 875699

SEQ ID NO: 875710 - protein, 758 aa, Homo sapiens; identical to SEQ ID NO: 875699

SEQ ID NO: 875711 - protein, 503 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALRRDVTSKNVS

SEQ ID NO: 875712 - protein, 157 aa, Homo sapiens
TPGASCQNRCQRGGGALLNGTSISPGENGLQSLTSSLDDSTAREGKGIHRGGRRLPLPGQTRAWAAASVFILKPYRARLCSRLRMSYFRPQPKSATANYTANNGEGACSARLETPERQRKDSDFSLGQSPSAASPRSGCAPRSGSGHTPRGQGDRAA

SEQ ID NO: 875713 - protein, 254 aa, Homo sapiens
MGYFLKLYAYVNSHSLFVWVCDRSYKRSFRPMILNKIKELSRNQFSTMSHLRKDSQPSSPGDDAMDRSGLPDLQGRFELSGKNRQYPLDALEPQPSIGDIKDIKTPSLVFLCFIFDGLHQALLSVGVSKRSNTVVGNENEERGTPYASRFKDMPNFIALEKSSVLRHCCDLLIGIAAGSSDKICTSSLQVQRRFKAMMASIGRLSHGESADLLISCNAESAIGWISSRPWVGELMFTLLFGDFESPLHKLRKSS

SEQ ID NO: 875714 - protein, 187 aa, Homo sapiens
MGYFLKLYAYVNSHSLFVWVCDRSYKRSFRPMILNKIKELSRNQFSTMSHLRKDSQPSSPGDDAMDRSGLPDLQGRFELSGKNRQYPLDALEPQPSIGDIKDIKKAAKSMLDPAHKSHFHPVTPSLVFLCFIFDGLHQALLSVGVSKRSNTVVGNENEERGTPYASRFKDMPNFIALEKSSVLPPLL

SEQ ID NO: 875715 - protein, 101 aa, Homo sapiens
SNALPPNSYHLEASTRPVPHSREPSAPIQGPHFTPSLKPVCGCPHLPPARGGCSLTRWLHLSLPVTMVVLPPLNSGTLQRLLNTSELESLLQGMQVMKMRA

SEQ ID NO: 875716 - protein, 400 aa, Homo sapiens
DPRAKEKSPLKQFSFSLSFSFRGEPSCSCEGHLLRKTPQLSRGASAGGSDSFENPGLPLPVPPGVRVSGARVFREGQARWALGSCARRADRGIMEADKDDTQQILKEHSPDEFIKDEQNKGLIDEITKKNIQLKKEIQKLETELQEATKEFQIKEDIPETKMKFLSVETPENDSQLSNISCSFQVSSKVPYEIQKGQALITFEKEEVAQNVVSMSKHHVQIKDVNLEVTAKPVPLNSGVRFQVYVEVSKMKINVTEIPDTLREDQMRDKLELSFSKFRNGGGEVDRVDYDRQSGSAVITFVEIGVADKILKKKEYPLYINQTCHRVTVSPYTEIHLKKYQIFSGTSKRTVLLTGMEGIQMDEEIVEDLINIHFQRAKNGGGEVDVVKCSLGQPHIAYFEE

SEQ ID NO: 875717 - protein, 156 aa, Homo sapiens
WKKTISAGRGRAVRRRRMEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875718 - protein, 139 aa, Homo sapiens
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875719 - protein, 139 aa, Homo sapiens; identical to SEQ ID NO: 875718

SEQ ID NO: 875720 - protein, 139 aa, Homo sapiens; identical to SEQ ID NO: 875718

SEQ ID NO: 875721 - protein, 152 aa, Homo sapiens
MAKVRGWVSRRRRMEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875722 - protein, 103 aa, Homo sapiens
MLLPSLCRFVWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875723 - protein, 147 aa, Homo sapiens
KQTKRFVAAKAACGEVTVKVLPKEVWKESPFQIALNFKTFCLGKVGQQHLNQGYWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875724 - protein, 139 aa, Homo sapiens; identical to SEQ ID NO: 875718

SEQ ID NO: 875725 - protein, 107 aa, Homo sapiens
MAGVSTCRDLSHPGVDSFAKGAKLLPSLCRFVWVIPELIGHTIVTVLLLMSLHWFIFLLNLPVATWNIYRNRGQLKSHMKEAMIKLGFHLLCFFMYLYSMILALIND

SEQ ID NO: 875726 - protein, 137 aa, Homo sapiens
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSGSNCPC

SEQ ID NO: 875727 - protein, 137 aa, Homo sapiens; identical to SEQ ID NO: 875726

SEQ ID NO: 875728 - protein, 139 aa, Homo sapiens; identical to SEQ ID NO: 875718

SEQ ID NO: 875729 - protein, 139 aa, Homo sapiens; identical to SEQ ID NO: 875718

SEQ ID NO: 875730 - protein, 139 aa, Homo sapiens; identical to SEQ ID NO: 875718

SEQ ID NO: 875731 - protein, 139 aa, Homo sapiens; identical to SEQ ID NO: 875718

SEQ ID NO: 875732 - protein, 139 aa, Homo sapiens; identical to SEQ ID NO: 875718

SEQ ID NO: 875733 - protein, 103 aa, Homo sapiens
GGLRTRCRDKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 875734 - protein, 139 aa, Homo sapiens; identical to SEQ ID NO: 875718

SEQ ID NO: 875735 - protein, 121 aa, Homo sapiens
MEAVVFVFSLLDCCALIFLSVYFIITLSDLECDYINARSCCSKLNKWVIPELIGHTIVTVLLLMSLHWFIFLLNLPVATWNIYRNRGQLKSHMKEAMIKLGFHLLCFFMYLYSMILALIND

SEQ ID NO: 875736 - protein, 133 aa, Homo sapiens
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMI

SEQ ID NO: 875737 - protein, 92 aa, Homo sapiens
MEAVVFVFSLLDCCALIFLSVYFIITLSDLECDYINARSCCSKLNKWVIPELIGHTIVTVLLLMSLHWFIFLLNLPVATWNIYRMILALIND

SEQ ID NO: 875738 - protein, 370 aa, Homo sapiens
MNYSHDNWSAILAHIGKPEELDTSARNAGALTRRREIRDAATLLRLGLAYGPGGMSLREVTAWAQLHDVATLSDVALLKRLRNAADWFGILAAQTLAVRAAVTGCTSGKRLRLVDGTAISAPGGGSAEWRLHMGYDPHTCQFTDFELTDSRDAERLDRFAQTADEIRIADRGFGSRPECIRSLAFGEADYIVRVHWRGLRWLTAEGMRFDMMGFLRGLDCGKNGETTVMIGNSGNKKAGAPFPARLIAVSLPPEKALISKTRLLSENRRKGRVVQAETLEAAGHVLLLTSLPEDEYSAEQVADCYRLRWQIELAFKRLKSLLHLDALRAKEPELAKAWIFANLLAAFLIDDIIQPSLDFPPRSAGSEKKN

SEQ ID NO: 875739 - protein, 104 aa, Homo sapiens
MALTGVHVPQAALWGLPWPGHASLEEGWVCTAQQGSPHCPTQQSPARGSNWESWGRACASPLMSTMLGTGSAHRRMSGDLAPGAGSRGIGPSTAFPSPSSGSAG

SEQ ID NO: 875740 - protein, 68 aa, Homo sapiens
ESFLIMPLEDALRTPVMNPKNSVSIIPGIGHLITPVLSLKGLHNNVLKESPIMSFRMELDLPKLLCTC

SEQ ID NO: 875741 - protein, 103 aa, Homo sapiens [sequence omitted]

SEQ ID NO: 875742 - protein, 87 aa, Homo sapiens
RWMGGGRDAPHFPDYGRPGRGAPLPHRPVWEARSASTQPPHLGGVPNISEETATIKNGAMMTMLVLCQRKGGNVGKRKRDQTVTVSV

SEQ ID NO: 875743 - protein, 115 aa, Homo sapiens [sequence omitted]

SEQ ID NO: 875744 - protein, 115 aa, Homo sapiens [sequence omitted]

SEQ ID NO: 875745 - protein, 1600 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875746 - protein, 681 aa, Homo sapiens
MIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875747 - protein, 1574 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVNSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875748 - protein, 332 aa, Homo sapiens
MHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875749 - protein, 332 aa, Homo sapiens; identical to SEQ ID NO: 875748

SEQ ID NO: 875750 - protein, 215 aa, Homo sapiens
ITGVSHRTRPRFPVLQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875751 - protein, 1587 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLRCFLVDYRKSLNLFFKKDKNFGVCY

SEQ ID NO: 875752 - protein, 1441 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQQKKIKKFVQSNFL

SEQ ID NO: 875753 - protein, 1038 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFVTRK

SEQ ID NO: 875754 - protein, 2209 aa, Homo sapiens
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKLQGQIKSSFISTENYHTLGCLSLVAGDLASEVPVIIGGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875755 - protein, 768 aa, Homo sapiens [sequence omitted]

SEQ ID NO: 875756 - protein, 689 aa, Homo sapiens
MLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875757 - protein, 397 aa, Homo sapiens
GIRHEQGRLCGYRLRKDLTTELSWELTIPPEVQRIVKVKGKRSSEHVHSQGRVMGDRSVLYKTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875758 - protein, 353 aa, Homo sapiens
SSLSYSRATPHTRPRTGQTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875759 - protein, 130 aa, Homo sapiens
MLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 875760 - protein, 1280 aa, Homo sapiens
FPFGVFALEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTVSSRNLIQTLLCISA

SEQ ID NO: 875761 - protein, 74 aa, Homo sapiens
RQSLAPKGLATSTMKTAVPTDSAISPAGSHPKEISQKEKAILRKDDHCVITQNSPKLGNTQLSSNRGSELQNIN

SEQ ID NO: 875762 - protein, 179 aa, Homo sapiens
ARQQVGAFSRARARVEALYITFPESSVPLPAGSARLPSSRRVLLGLSEPHTPRSSCHSRRLRGGSPAPRLSLGAASPRPRPPSLPLPLPLPFPLFLPTRPAERAWIRSRRASEWVGKMEVPRLDHALNSPTSPCEEVIKNLSLEAIQLCDRDGKSGRDREERDRVRAEAPGPLWLRRRR

SEQ ID NO: 875763 - protein, 493 aa, Homo sapiens
ARQQVGAFSRARARVEALYITFPESSVPLPAGSARLPSSRRVLLGLSEPHTPRSSCHSRRLRGGSPAPRLSLGAASPRPRPPSLPLPLPLPFPLFLPTRPAERAWIRSRRASEWVGKMEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSLGTVAEITGHQLMSLSTANAKKDPSCKTCNISVGR

SEQ ID NO: 875764 - protein, 493 aa, Homo sapiens; identical to SEQ ID NO: 875763

SEQ ID NO: 875765 - protein, 406 aa, Homo sapiens
MEVPRLDHALNSPTSPCEEVIKNLSLEAIQLCDRDVFLKNLHPNRQEKDKSTIGSWQVITFEVINWNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSLGTVAEITGHQLMSLSTANAKKDPSCKTCNISVGR

SEQ ID NO: 875766 - protein, 316 aa, Homo sapiens
ARQQVGAFSRARARVEALYITFPESSVPLPAGSARLPSSRRVLLGLSEPHTPRSSCHSRRLRGGSPAPRLSLGAASPRPRPPSLPLPLPLPFPLFLPTRPAERAWIRSRRASEWVGKMEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVR

SEQ ID NO: 875767 - protein, 306 aa, Homo sapiens
ARQQVGAFSRARARVEALYITFPESSVPLPAGSARLPSSRRVLLGLSEPHTPRSSCHSRRLRGGSPAPRLSLGAASPRPRPPSLPLPLPLPFPLFLPTRPAERAWIRSRRASEWVGKMEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTAGKRTRYKYRKALVVLGKLIIEKYFFFVIIK

SEQ ID NO: 875768 - protein, 493 aa, Homo sapiens; identical to SEQ ID NO: 875763

SEQ ID NO: 875769 - protein, 493 aa, Homo sapiens; identical to SEQ ID NO: 875763

SEQ ID NO: 875770 - protein, 350 aa, Homo sapiens [sequence omitted]

SEQ ID NO: 875771 - protein, 171 aa, Homo sapiens [sequence omitted]

SEQ ID NO: 875772 - protein, 113 aa, Homo sapiens
PHVAHRPWVGQACSKCLVFFPQFTSSYLHAKWAADTRQSLGKIYSFNTNIIYKGKGRSLKEHRKPKDLIERLLRTSSFLQLCQKVTKLLAGPARQGSQADNGALAELSARVRF

SEQ ID NO: 875773 - protein, 1319 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 875774 - protein, 1259 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVSTLSRATPAESHHKVILLSD

SEQ ID NO: 875775 - protein, 1355 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIARTASKFLALSQGILTELCLRVGRFTTGRVLHRQGQVEHRMVPTIGCLAAALNVAPVNSGMHS

SEQ ID NO: 875776 - protein, 1319 aa, Homo sapiens; identical to SEQ ID NO: 875773

SEQ ID NO: 875777 - protein, 100 aa, Homo sapiens
RTRGSTHASGVHLPTWASSVFSGITLTKFGGIVVLAFAKSQIFQIFYFRMYLAMVLLGATHGLIFLPVLLSYIGPSVNKAKSCATEERYKGTERERLLNF

SEQ ID NO: 875778 - protein, 1327 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIAKLLERTIYLCISQHIHYATQMAPLQCLMTASDRC

SEQ ID NO: 875779 - protein, 1259 aa, Homo sapiens; identical to SEQ ID NO: 875774

SEQ ID NO: 875780 - protein, 594 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDGK

SEQ ID NO: 875781 - protein, 694 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISQKKINIYNYKIIIIFIFFINIFIIIY

SEQ ID NO: 875782 - protein, 1319 aa, Homo sapiens; identical to SEQ ID NO: 875773

SEQ ID NO: 875783 - protein, 1011 aa, Homo sapiens
MGLQECPKNNLTVMKSTNAISSLLFFRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 875784 - protein, 1433 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYVSTTLSCTSEAAEEALSQAVSSGLKCLTENRLSWKSCFYAKCMLNLALPEKTFERTNLPPNTLKAFFIKCSCSFSFDCEQYKNVEKEVRFEEKVLKLKTSSLWSRSVTLSVLSSTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 875785 - protein, 1319 aa, Homo sapiens; identical to SEQ ID NO: 875773

SEQ ID NO: 875786 - protein, 1259 aa, Homo sapiens; identical to SEQ ID NO: 875774

SEQ ID NO: 875787 - protein, 1303 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGKSSHLKRVAQ

SEQ ID NO: 875788 - protein, 852 aa, Homo sapiens
FAPAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEVSWCQDYSLFNLSLESRGSS

SEQ ID NO: 875789 - protein, 57 aa, Homo sapiens
MEFVFPFKRPFVRSCLVNYSKHLSPFSFGFPLLAMYNACRDVEAPSSNDKALGLLCG

SEQ ID NO: 875790 - protein, 107 aa, Homo sapiens
MFTRKPQPNALPAHLCHIRHLDKLGPCMHINVMDCRFVLSTSTEHSLKIQLSKKSLFTCVSKKLFIFECMTHKLDTLQELKKQIYSRDSLVNLFILKIPLVTQFSDI

SEQ ID NO: 875791 - protein, 103 aa, Homo sapiens
RPGPCSQPHSPKYMFSGCGRKPEYPDELDIIQADMGRMCTLHTDSDLSQESGFLINDIMKRHWTGWAVWLTPVILALWEAEAGGSRGQKFKTSLAKMAKPRLY

SEQ ID NO: 875792 - protein, 139 aa, Homo sapiens
IKVYNAHSGATKPTSKHGPKDRPGVKMVLGYTRAWLVMRTRRGGRFCELWDNHAEHRAATRRCGVMRESTQDKLIEKGQGTASLLGSHACSQGKGHTWMGLFIKRISGWNPIKLLAVTASQKEERGSEGGRSFSLCAPL

SEQ ID NO: 875793 - protein, 172 aa, Homo sapiens [sequence omitted]

SEQ ID NO: 875794 - protein, 289 aa, Homo sapiens
VRQRRVASRRRIRRSAKSAPARSLGLALQLPLPRRPLGLRARRDHVHQHRLQWALWSFSLSSRLEYNGVISAHCSLCLLGSNKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAHKVLVSRTSITKPRTMHSYYYLGQLAALHHHPTMRIPVSRSWATLERPTYNTGEHYNCYPVNLIVRH

SEQ ID NO: 875795 - protein, 415 aa, Homo sapiens
VRQRRVASRRRIRRSAKSAPARSLGLALQLPLPRRPLGLRARRDHVHQHRLQWALWSFSLSSRLEYNGVISAHCSLCLLGSNKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 875796 - protein, 312 aa, Homo sapiens
RSSAASGLAAPDSSLRQECACAVAGARTSASPPPAPSGAPSPAGPCSPAPAPVGSTRRLCRRAFCWSPVPSPSCSPSSCLTARSSLCMTFTQSRTTSSLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 875797 - protein, 388 aa, Homo sapiens
FVSGEWPRGAGFVAPPRVRLRGRWGSHFSFPSPGALWGSEPGGTMFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 875798 - protein, 284 aa, Homo sapiens
FVSGEWPRGAGFVAPPRVRLRGRWGSHFSFPSPGALWGSEPGGTMFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLIRCSASPAGWQNSFLGHLNPSSLLQNPPAKPELGWEPRWTSRDSREWSCWTGS

SEQ ID NO: 875799 - protein, 388 aa, Homo sapiens; identical to SEQ ID NO: 875797

SEQ ID NO: 875800 - protein, 388 aa, Homo sapiens; identical to SEQ ID NO: 875797

SEQ ID NO: 875801 - protein, 388 aa, Homo sapiens; identical to SEQ ID NO: 875797

SEQ ID NO: 875802 - protein, 388 aa, Homo sapiens; identical to SEQ ID NO: 875797

SEQ ID NO: 875803 - protein, 356 aa, Homo sapiens
FVSGEWPRGAGFVAPPRVRLRGRWGSHFSFPSPGALWGSEPGGTMFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQTNE

SEQ ID NO: 875804 - protein, 388 aa, Homo sapiens; identical to SEQ ID NO: 875797

SEQ ID NO: 875805 - protein, 157 aa, Homo sapiens
MSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 875806 - protein, 157 aa, Homo sapiens; identical to SEQ ID NO: 875805

SEQ ID NO: 875807 - protein, 254 aa, Homo sapiens
FVSGEWPRGAGFVAPPRVRLRGRWGSHFSFPSPGALWGSEPGGTMFTSTGSSGLYKAPLSKSLLLVPSALSLLLALLLPHCQKLFVYDLHAVKNDFQMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 875808 - protein, 388 aa, Homo sapiens; identical to SEQ ID NO: 875797

SEQ ID NO: 875809 - protein, 388 aa, Homo sapiens; identical to SEQ ID NO: 875797

SEQ ID NO: 875810 - protein, 388 aa, Homo sapiens; identical to SEQ ID NO: 875797

SEQ ID NO: 875811 - protein, 357 aa, Homo sapiens
FVSGEWPRGAGFVAPPRVRLRGRWGSHFSFPSPGALWGSEPGGTMFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVINQ

SEQ ID NO: 875812 - protein, 257 aa, Homo sapiens
MTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSGDVVGHQDGGEVPAVDESFEVRKMDWMAPRVEGLLEEEQKEAEGAVAEAEVALVGEEEGFLLKEWETFNPADYAEPANTDDNYGNSSGNTWNNTGHFEPDDGTSAWRTATLVPNSARGVSRDRAIAL

SEQ ID NO: 875813 - protein, 472 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQSCSSCPRQQPWQETSLAQDQ

SEQ ID NO: 875814 - protein, 203 aa, Homo sapiens
MAENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRQRTALTSSAGSCVRIPSGSCRPMSC

SEQ ID NO: 875815 - protein, 106 aa, Homo sapiens
MALSGQLGLPWVEWGGEHKGGRRRYLGQKVPPPVTVIVLIPGSWCKRWRLLVEFMFPRPHTRSHRTLESSHHQGLELSAGCRLRGGGGRHTIDRRFSSGLLVSTLP

SEQ ID NO: 875816 - protein, 250 aa, Homo sapiens
MSENAAPDFYYVAMDFGGHGLSSHYSPGVPYYLQTFVSEIRRVVAGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 875817 - protein, 172 aa, Homo sapiens
MDRSNPVKPALDYFSNRLVNYQISVKCSNQFKLEVCLLNAENKVVDNQAGTQGQLKVLGANLWWPYLMHEHPAYLYSWEEVIAHTKALDPSQPVTFVTNSTYAADKGALYVDVIRVNSYYSWYRNYGHLELIQLQLAAQFENWCKTSQSHYSERVWSGNACRVSPVFPRELR

SEQ ID NO: 875818 - protein, 157 aa, Homo sapiens
KSKEVPLPNPRNSQSKDTVQDITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSYREIHGAPSNFSSSHLESKHVYCVDVNEEKTE

SEQ ID NO: 875819 - protein, 176 aa, Homo sapiens
RSPAPRAPTRCALPRAEARPAGPRAGGRASARAEAARWLIRARRASPGPGAGRGPAQPSSPRAGPRRPGSADQEKIMNVKGKVILSMLVVSTVIIVFWEFINSTEGSFLWIYHSKNPEVDDSSAQKGWWFLSWFNNGIHNYQQGEEDIDKEKGREETKGRKMTQQSFGYGTGLIQT

SEQ ID NO: 875820 - protein, 574 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 875821 - protein, 264 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNCFKRIAWARMSR

SEQ ID NO: 875822 - protein, 574 aa, Homo sapiens; identical to SEQ ID NO: 875820

SEQ ID NO: 875823 - protein, 126 aa, Homo sapiens [sequence omitted]

SEQ ID NO: 875824 - protein, 126 aa, Homo sapiens [sequence omitted]

SEQ ID NO: 875825 - protein, 483 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 875826 - protein, 524 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 875827 - protein, 610 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGSANFCKYGTKGEAGSVAFSGFERKRIINSVKFPLDLTYKIKIQCNLKCFLIYSILTGLSSMKMISK

SEQ ID NO: 875828 - protein, 610 aa, Homo sapiens; identical to SEQ ID NO: 875827

SEQ ID NO: 875829 - protein, 96 aa, Homo sapiens
STQPGSDEGISRGSLSISPRCLAQSSPSSGPWAGSPLISPLLVEAGETANGYQDLRRCGWEIGYECMEITKQGDGSPCVVSVIHLRVRSSSSPPGE

SEQ ID NO: 875830 - protein, 156 aa, Homo sapiens
ANNWLSLRSCYPIFPDPRSLQIRSTSHLGQQLFPLPGDKAGVQRAEEGASSATRWRARASQRPGGHSSSPSPHSSPTRARAQKEPRPQPSRAGQPGAHLEGPGSGRVAAASSPCGSCCGLRVAPAPGSSSSRSPTLHPFSTPLCKSKASRSSLGAA

SEQ ID NO: 875831 - protein, 133 aa, Homo sapiens
EQGSREGSESQAEEMNEAGPPLEANTETRPEKEGPQPQEKPVGALEEEGVKPQTAAEGQGPLGDATPLLAETPAPEQPAECQPLLQGEGPSANPSAHPVPTYAPARQPEPSAPTEGEEASGPKQKTCQCCAVM

SEQ ID NO: 875832 - protein, 122 aa, Homo sapiens
VDYALTYDESTWMTRKIKIKRCCYRQSSSPRGLHEIQATETTRVGLTYHSTDKVTRSKCNSKYTVSTRQTHDMHTVSTLPGSLQSHFPHRERRKRPWPGSHSQSLWTWSQRLWRTKRHLFPG

SEQ ID NO: 875833 - protein, 103 aa, Homo sapiens
MDCSHLREKKTSTVFKPLFGFSVTCRHQDYQKTHQILPFFKKKTQSKFVFFSFSDLRVLISISVILVVTIKCLTNEKKMASIGLKGGALRSVPFKKKKLASLA

SEQ ID NO: 875834 - protein, 122 aa, Homo sapiens
MLLATIMDEEVTLRMRVKQKDRRSMGPGAWGLPISLDSLIWNGRKKLPLCLNLCLAFLSHVDIRITKRHFKKKTQSKFVFFSFSDLRVLISISVILVVTIKCLTNVFVHLFLKNIRTLLLQV

SEQ ID NO: 875835 - protein, 112 aa, Homo sapiens
HCPAPAVKCEVLRHRLFLFVTFIALEGIKDKLPQMTSLWYMDYFELQALEKQQVQAGPSDLPFSNQEQAMTFPTRYTLPLYQEENILITKHWEWMPRCICTNTLNKITLCFH

SEQ ID NO: 875836 - protein, 233 aa, Homo sapiens [sequence omitted]

SEQ ID NO: 875837 - protein, 233 aa, Homo sapiens [sequence omitted]

SEQ ID NO: 875838 - protein, 217 aa, Homo sapiens
MGGPVREPALSVALWLSWGAALGAVACAMALLTQQTELQSLRREVSRLQGTGGPSQNGEGYPWQSLPEQSSDALEAWESGERSRKRRAVLTQKQKNDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 875839 - protein, 233 aa, Homo sapiens [sequence omitted]

SEQ ID NO: 875840 - protein, 114 aa, Homo sapiens
MWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 875841 - protein, 233 aa, Homo sapiens [sequence omitted]

SEQ ID NO: 875842 - protein, 69 aa, Homo sapiens
VHPVICDGCNGPVVGTRYKCSVCPDYDLCRQPPQEALSYVLLSIYRTPVSITISRDVAIMRPSTGGARR

SEQ ID NO: 875843 - protein, 233 aa, Homo sapiens [sequence omitted]

SEQ ID NO: 875844 - protein, 233 aa, Homo sapiens [sequence omitted]

SEQ ID NO: 875845 - protein, 233 aa, Homo sapiens [sequence omitted]

SEQ ID NO: 875846 - protein, 264 aa, Homo sapiens
GLVRSGVYGMGPQLMPASSPFLLAPKGPPGNMGGPVREPALSVALWLSWGAALGAVACAMALLTQQTELQSLRREVSRLQGTGGPSQNGEGYPWQSLPEQSSDALEAWESGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 875847 - protein, 276 aa, Homo sapiens
LGHSAGAGTGPGWEVGRAGASLEEGLRVSRHTGTRNPVCWGGIPQWPGGLRPLLCLFVQSLIPQRASRQHGGPSQRAGTLSCPLVELGGSSGGRGLCHGSADPTNRAAEPQERGEPAAGDRRPLPEWGRVSLAESPGAEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 875848 - protein, 230 aa, Homo sapiens
MGGPVREPALSVALWLSWGAALGAVACAMALLTQQTELQSLRREVSRLQGTGGPSQNGEGYPWQSLPEQSSDALEAWESGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGL

SEQ ID NO: 875849 - protein, 233 aa, Homo sapiens [sequence omitted]

SEQ ID NO: 875850 - protein, 210 aa, Homo sapiens
MGGPVREPALSVALWLSWGAALGAVACAMALLTQQTELQSLRREVSRLQGTGGPSQNGEGYPWQSLPEQSSDALEAWESGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHLGAHWKH

SEQ ID NO: 875851 - protein, 70 aa, Homo sapiens
QTLPFSPAISASLSVAVEAGRPFCHCLAGLGRGSAGQRARQGGPEFLKVVVAAVRVHRLMISNVTQKRMC

SEQ ID NO: 875852 - protein, 70 aa, Homo sapiens; identical to SEQ ID NO: 875851

SEQ ID NO: 875853 - protein, 658 aa, Homo sapiens
RASNPEGRPGSAATMFLGTGEPALDTSHLISLSRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 875854 - protein, 343 aa, Homo sapiens
MESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 875855 - protein, 658 aa, Homo sapiens; identical to SEQ ID NO: 875853

SEQ ID NO: 875856 - protein, 658 aa, Homo sapiens; identical to SEQ ID NO: 875853

SEQ ID NO: 875857 - protein, 350 aa, Homo sapiens
MESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPGNFIHLDSGTRAAGLLRSQPKSGHLQEARAVSGRKGGVSHLELPLN

SEQ ID NO: 875858 - protein, 658 aa, Homo sapiens; identical to SEQ ID NO: 875853

SEQ ID NO: 875859 - protein, 100 aa, Homo sapiens [sequence omitted]

SEQ ID NO: 875860 - protein, 100 aa, Homo sapiens [sequence omitted]

SEQ ID NO: 875861 - protein, 100 aa, Homo sapiens [sequence omitted]

SEQ ID NO: 875862 - protein, 116 aa, Homo sapiens
LSPHWDLLTGLGCSGDMEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 875863 - protein, 141 aa, Homo sapiens
MCAKRVSFPVFLYRECCSVLLPLFPRPCCHVVCPRRYLGPAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSA

SEQ ID NO: 875864 - protein, 100 aa, Homo sapiens [sequence omitted]

SEQ ID NO: 875865 - protein, 100 aa, Homo sapiens [sequence omitted]

SEQ ID NO: 875866 - protein, 116 aa, Homo sapiens
LLTNETLLCTFNLLSAREEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 875867 - protein, 100 aa, Homo sapiens [sequence omitted]

SEQ ID NO: 875868 - protein, 100 aa, Homo sapiens [sequence omitted]

SEQ ID NO: 875869 - protein, 100 aa, Homo sapiens [sequence omitted]

SEQ ID NO: 875870 - protein, 320 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 875871 - protein, 320 aa, Homo sapiens; identical to SEQ ID NO: 875870

SEQ ID NO: 875872 - protein, 320 aa, Homo sapiens; identical to SEQ ID NO: 875870

SEQ ID NO: 875873 - protein, 320 aa, Homo sapiens; identical to SEQ ID NO: 875870

SEQ ID NO: 875874 - protein, 270 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNDIRWTSSRSGYRLEGLSMPELPLARYGDTRASWTVPSRCYKRKAPWASSRACPPAC

SEQ ID NO: 875875 - protein, 215 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVRRYKGLMDCAKQVLQKEGALGFFKGLSPSLLKAALSTGFMFFSYEFFCNVFHCMNRTASQR

SEQ ID NO: 875876 - protein, 219 aa, Homo sapiens
MLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 875877 - protein, 38 aa, Homo sapiens
MFSIAAALGSSASSAGGDSRLSQSLSGLCRFYPSRTSL

SEQ ID NO: 875878 - protein, 320 aa, Homo sapiens; identical to SEQ ID NO: 875870

SEQ ID NO: 875879 - protein, 320 aa, Homo sapiens; identical to SEQ ID NO: 875870

SEQ ID NO: 875880 - protein, 320 aa, Homo sapiens; identical to SEQ ID NO: 875870

SEQ ID NO: 875881 - protein, 319 aa, Homo sapiens
NFGTMGQRITPKFQGGSELGLCLYLVLGRLIITFVTVCVMCNELCSSQCGFRQRQVVPCYGKPMLRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 875882 - protein, 270 aa, Homo sapiens; identical to SEQ ID NO: 875874

SEQ ID NO: 875883 - protein, 325 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQTEIQGSMDCASSAARRAWLSGLSQCGVALPGQSLGGSPGAPWLGPRVGGPFRGAQEEIPRGGAWAGP

SEQ ID NO: 875884 - protein, 97 aa, Homo sapiens
KGLLPSSNPMFSIAAALGSSASSAGGDSRLSQSLSGPRAQTFVSADTPPPRLSSPRTGLVMAVGLHGKQIPAPVQEVDGPCCGQAWVKVQPLPSLPH

SEQ ID NO: 875885 - protein, 162 aa, Homo sapiens
FHIRKNHHTTRPNIFYLLKDTGCSLPGLPTESLFYRAVLQDIIKDCYGITKCDRHVGKIYSKCSSFLDYVRRSLKKLGLDESKLPEKIIMNYYEKYKPRMNELEAFNMLKVVLAPCIETLILLDRLCYLKEQEDIAWSALVKLFDPVKSPRCYAVIALKKQQ

SEQ ID NO: 875886 - protein, 162 aa, Homo sapiens; identical to SEQ ID NO: 875885

SEQ ID NO: 875887 - protein, 100 aa, Homo sapiens
EDGDKLEKLVGKEREKVSVATLPEKIIMNYYEKYKPRMNELEAFNMLKVVLAPCIETLILLDRLCYLKEQEDIAWSALVKLFDPVKSPRCYAVIALKKQQ

SEQ ID NO: 875888 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPVKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 875889 - protein, 543 aa, Homo sapiens; identical to SEQ ID NO: 875888

SEQ ID NO: 875890 - protein, 543 aa, Homo sapiens; identical to SEQ ID NO: 875888

SEQ ID NO: 875891 - protein, 412 aa, Homo sapiens
MAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPVKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 875892 - protein, 163 aa, Homo sapiens
MGDQPNLPYVLAFLYEAMRFSSFVPVTIPHATTANTSVLGYHIPKDTVVFVNQWSVNHDPVKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQ

SEQ ID NO: 875893 - protein, 543 aa, Homo sapiens; identical to SEQ ID NO: 875888

SEQ ID NO: 875894 - protein, 543 aa, Homo sapiens; identical to SEQ ID NO: 875888

SEQ ID NO: 875895 - protein, 543 aa, Homo sapiens; identical to SEQ ID NO: 875888

SEQ ID NO: 875896 - protein, 139 aa, Homo sapiens
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKV

SEQ ID NO: 875897 - protein, 337 aa, Homo sapiens
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGYFEAFKNELEAFKSRVRLYSQSQSFQPMTVQNHVPHSGVGSIGLLESLPQNPDYLQYSISTALCSLNSVVHKEDDEPKMMDTV

SEQ ID NO: 875898 - protein, 97 aa, Homo sapiens
IQLVTESWRHKPVATPGPWSLPRAEGEAEEESDFDVFPSSPRCPQLPGGGAQVRRGLRSAEGWSGAVAKPLECRVSQTLFYAFFYAHLTARGRGPGT

SEQ ID NO: 875899 - protein, 214 aa, Homo sapiens
LEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEV

SEQ ID NO: 875900 - protein, 254 aa, Homo sapiens
EVSPASSRRSLRASRAITTPWGPETVFRSFAFGWGVEAAVLRRPGRAQEQPRGALSGRRPGGKRCSGDRATPQRRSAPGPRGEVGGVRPAPPRTTPPRARTFPECTPRPPAGAMAGLWLGLVWQKLLLWGAASAVSLAGASLVLSLLQRVASYARKWQQMRPIPTVARAYPLVGHALLMKPDGRAQDAVFPNPCPRSFPTSPLLSSQSPAVSSCLGLGSLRNRSSLGAQSGFKLANTLTPRAALLSLPLWKIRD

SEQ ID NO: 875901 - protein, 107 aa, Homo sapiens [sequence omitted]

SEQ ID NO: 875902 - protein, 291 aa, Homo sapiens
EVSPASSRRSLRASRAITTPWGPETVFRSFAFGWGVEAAVLRRPGRAQEQPRGALSGRRPGGKRCSGDRATPQRRSAPGPRGEVGGVRPAPPRTTPPRARTFPECTPRPPAGAMAGLWLGLVWQKLLLWGAASAVSLAGASLVLSLLQRVASYARKWQQMRPIPTVARAYPLVGHALLMKPDGRGKGRRSSWSATGSAAPFPPSDQPGTRCLWRWPQERGACHPVENALPVLVVAPWHPPTLLVPHPKVSIFFVCSTGCGISKPLPSVFSHLTAAQLSKPCRFLLPWLGKP

SEQ ID NO: 875903 - protein, 452 aa, Homo sapiens
EVSPASSRRSLRASRAITTPWGPETVFRSFAFGWGVEAAVLRRPGRAQEQPRGALSGRRPGGKRCSGDRATPQRRSAPGPRGEVGGVRPAPPRTTPPRARTFPECTPRPPAGAMAGLWLGLVWQKLLLWGAASAVSLAGASLVLSLLQRVASYARKWQQMRPIPTVARAYPLVGHALLMKPDGREFFQQIIEYTEEYRHMPLLKLWVGPVPMVALYNAENVEVILTSSKQIDKSSMYKFLEPWLGLGLLTSTGNKWRSRRKMLTPTFHFTILEDFLDIMNEQANILVKKLEKHINQEAFNCFFYITLCALDIICETAMGKNIGAQSNDDSEYVRAVYRMSEMIFRRIKMPWLWLDLWYLMFKEGWEHKKSLQILHTFTNSVIAERANEMNANEDCRGDGRGSAPSKNKRRAFLDLLLSVTDDEGNRLSHEDIREEVDTFMFEVLYIVRFRYH

SEQ ID NO: 875904 - protein, 65 aa, Homo sapiens
MGYLKAVERAIYNMRLGLHRWIQGPPPLRHLLTHLPQVRLTSTFLLTSTQGAQEKPREQGGGNAR

SEQ ID NO: 875905 - protein, 119 aa, Homo sapiens
MPCVLAMSSQGYNVLVPDHPGLPLEVKDRIASWHYRCGKIKISARGAERRVPQLQEDHVTAVVVFGVTCSTHSVPLMLDGDRRRACRPNPWLWTGEAAPGFFPSQCFTQDFLHLCFPLV

SEQ ID NO: 875906 - protein, 137 aa, Homo sapiens
MPCVLAMSSQGYNVLVPDHPGLPLEVKDRIASWHYRCGKIKISARKNVRFGDSGRTRRSGGHFGAERRVPQLQEDHVTAVVVFGVTCSTHSVPLMLDGDRRRACRPNPWLWTGEAAPGFFPSQCFTQDFLHLCFPLV

SEQ ID NO: 875907 - protein, 186 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNSCTQKKAHMRTQQEGGCLQAKKRGLIRDGMFLHFGLDF

SEQ ID NO: 875908 - protein, 160 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIFLLEDDIHVS

SEQ ID NO: 875909 - protein, 165 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQEYFS

SEQ ID NO: 875910 - protein, 214 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQGDPDLPMSFTLAIVESDSTIVYYKLTDGFMLPDPQVSFEVTDSKKYKKRKIMT

SEQ ID NO: 875911 - protein, 190 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRRNNPYIFIKDINKKQLSPSCESDPNPFNVFIDSVVHRRKPI

SEQ ID NO: 875912 - protein, 202 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQGDPDLPMSFTLAIVESDSTIVYYKLTDGFMLPDPQNISLRR

SEQ ID NO: 875913 - protein, 202 aa, Homo sapiens; identical to SEQ ID NO: 875912

SEQ ID NO: 875914 - protein, 69 aa, Homo sapiens
GSGYERNGPHTKLRVKIREILKASRKLQGDPDLPMSFTLAIVESDSTIVYYKLTDGFMLPDPQNISLRR

SEQ ID NO: 875915 - protein, 149 aa, Homo sapiens
SLGEAEPTGARAAASGRARVVVHHGSAAPAGMEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNR

SEQ ID NO: 875916 - protein, 347 aa, Homo sapiens
METPFYGDEALSGLGGGASGSGGTFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 875917 - protein, 331 aa, Homo sapiens
RGYKRAHKWRGAGAAASGGPGAAAAAGAGAGPSGRGGAGPPGGRGHSPPGRRGGGGGGWKHPSTAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 875918 - protein, 153 aa, Homo sapiens
MCGDFTKHLICFILTSTPILRGAYCYQTHFTRQELREGAAPGDSPPEGAQDSTSWTPCSRGGERMTPPPSRCLFPPRGRPVLHKPARLGCPFVHRAARGLRGGAPQTLPFLYFYFFFFSLEERRTECSILPYLCFYSGTNVGCVCVCFLVLVF

SEQ ID NO: 875919 - protein, 347 aa, Homo sapiens; identical to SEQ ID NO: 875916

SEQ ID NO: 875920 - protein, 347 aa, Homo sapiens; identical to SEQ ID NO: 875916

SEQ ID NO: 875921 - protein, 200 aa, Homo sapiens
METPFYGDEALSGLGGGASGSGGTFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGRGRKSWLVIILKSQLMLLQLKKLCSHITVFNVLCGKLLSLYNFA

SEQ ID NO: 875922 - protein, 83 aa, Homo sapiens
MGGWPGVLSAYCLVVVDVVVASAGQWLRLHSAGGLMVGRPSPAGRPEQEPRANKEAANELAGAVDLGWMANVRRNPRDMVTST

SEQ ID NO: 875923 - protein, 961 aa, Homo sapiens [sequence omitted]

SEQ ID NO: 875924 - protein, 2402 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLYSKGLDICIVIRIVGMMTFHLCQKY

SEQ ID NO: 875925 - protein, 2043 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKASRN

SEQ ID NO: 875926 - protein, 2043 aa, Homo sapiens; identical to SEQ ID NO: 875925

SEQ ID NO: 875927 - protein, 804 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYSCHDSLYVYPSARFPVCTCLTSATHLHGPQCLLGSSCKTCQSCHLKGREGEERKEVNQLILLKEKEREDKARLLLFFNKINKTADKMPF

SEQ ID NO: 875928 - protein, 2691 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 875929 - protein, 2706 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 875930 - protein, 2739 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 875931 - protein, 175 aa, Homo sapiens
MVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 875932 - protein, 1630 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEMGAGETQSPSTERRKPSYRAPCPPQVRV

SEQ ID NO: 875933 - protein, 682 aa, Homo sapiens
MSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENAEAQESLKPRRQRLQ

SEQ ID NO: 875934 - protein, 47 aa, Homo sapiens
MSFVGNCGTFTRGYRAMVLDVEFLYHLLYLVICAMGLFVHEFFYSLL

SEQ ID NO: 875935 - protein, 352 aa, Homo sapiens
MSDIRHSLLRRDALSAAKEVLYHLDIYFSSQLQSAPLPIVDKGPVELLEEFVFQVPKERSAQPKEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 875936 - protein, 449 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 875937 - protein, 414 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNKTVVRMRPSGVCEFLILLLATWRPPQTQSSGL

SEQ ID NO: 875938 - protein, 430 aa, Homo sapiens
MSDIRHSLLRRDALSAAKEVLYHLDIYFSSQLQSAPLPIVDKGPVELLEEFVFQVPKERSAQPKEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 875939 - protein, 479 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNKTLNFGVVCKASFLGLLLGIQPPPAGDLGSRAAVASRRAPPGVLPQIESHTEEGEEEHVTGGKRHGTPEAESNDTQAATHGGQNEGPHSSASNGERA

SEQ ID NO: 875940 - protein, 383 aa, Homo sapiens [sequence omitted]

SEQ ID NO: 875941 - protein, 405 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRGGVSLLCPGWSAVVRSRLIATSASRVLVILPPQPPK

SEQ ID NO: 875942 - protein, 339 aa, Homo sapiens [sequence omitted]

SEQ ID NO: 875943 - protein, 411 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNKTLNFGVVCKASFLGLLLGIQVGRGHSRL

SEQ ID NO: 875944 - protein, 165 aa, Homo sapiens
TRRVGCSCSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 875945 - protein, 123 aa, Homo sapiens
MPFLYDISSCWTSFCFLFFSPLDGVLLCFPGWNAVARSQLTATSASQVQAILLVSASGVAGIIGTCHHAQPIFVFLVEMGFHHVGQACLKLLNSGDPPASASQSAGITGMSHHARPFFFFFSF

SEQ ID NO: 875946 - protein, 741 aa, Homo sapiens
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 875947 - protein, 741 aa, Homo sapiens; identical to SEQ ID NO: 875946

SEQ ID NO: 875948 - protein, 484 aa, Homo sapiens
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKIELLEEMIMADILVLPVFQAWPSQ

SEQ ID NO: 875949 - protein, 530 aa, Homo sapiens
RSRKQQKQEAAEAGSSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 875950 - protein, 705 aa, Homo sapiens
QLIKACNSTSEVKDLLEQKSKLTIEVAELQRQLQLEVKNQQNIKEERERMRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENEKLQGRSEELERRVAQLQRQIEDLKGDEAKAKETLKKYEGEIRQLEEALVHARKEEKEAVSARRALENELEAAQGNLSQTTQEQKQLSEKLKEESEQKEQLRRLKNEMENERWHLGKTIEKLQKEMADIVEASRTSTLELQNQLDEYKEKNRRELAEMQRQLKEKTLEAEKSRLTAMKMQDEMRLMEEELRDYQRAQDEALTKRQLLEQTLKDLEYELEAKSHLKDDRSRLVKQMEDKVSQLEMELEEERNNSDLLSERISRSREQMEQLRNELLQERAARQDLECDKISLERQNKDLKSRIIHLEGSYRSSKEGLVVQMEARIAELEDRLESEERDRANLQLSNRRLERKVKELVMQVDDEHLSLTDQKDQLSLRLKAMKRQVEEAEEEIDRLESSKKKLQRELEEQMDMNEHLQGQLNSMKKDLRLKKLPSKVLDDMDDDDDLSTDGGSLYEAPVSYTFSKDSTVASQI

SEQ ID NO: 875951 - protein, 656 aa, Homo sapiens
MRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENEKLQGRSEELERRVAQLQRQIEDLKGDEAKAKETLKKYEGEIRQLEEALVHARKEEKEAVSARRALENELEAAQGNLSQTTQEQKQLSEKLKEESEQKEQLRRLKNEMENERWHLGKTIEKLQKEMADIVEASRTSTLELQNQLDEYKEKNRRELAEMQRQLKEKTLEAEKSRLTAMKMQDEMRLMEEELRDYQRAQDEALTKRQLLEQTLKDLEYELEAKSHLKDDRSRLVKQMEDKVSQLEMELEEERNNSDLLSERISRSREQMEQLRNELLQERAARQDLECDKISLERQNKDLKSRIIHLEGSYRSSKEGLVVQMEARIAELEDRLESEERDRANLQLSNRRLERKVKELVMQVDDEHLSLTDQKDQLSLRLKAMKRQVEEAEEEIDRLESSKKKLQRELEEQMDMNEHLQGQLNSMKKDLRLKKLPSKVLDDMDDDDDLSTDGGSLYEAPVSYTFSKDSTVASQI

SEQ ID NO: 875952 - protein, 656 aa, Homo sapiens; identical to SEQ ID NO: 875951

SEQ ID NO: 875953 - protein, 656 aa, Homo sapiens; identical to SEQ ID NO: 875951

SEQ ID NO: 875954 - protein, 607 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIGEFEFIRFDKPGFTALAHPSSLTIGTTHGVFVLDPFDDLKHRDLEYRSCHRFLHKPSIEKMYQFNAVCRPGNFCQQDFAGGDIADLKLDSDYVYTDSLFYMDHKSAKMLLAFYEKIGTLSCEIDAYGDFLQALGPGATVEYTRNTSNVIKEESELVEMRQRIFHLLKGTSLNVVVLNNSKFYHIGTTEEYLFYFTSDNSLKSELGLQSITFSIFPDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 875955 - protein, 164 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFG

SEQ ID NO: 875956 - protein, 607 aa, Homo sapiens; identical to SEQ ID NO: 875954

SEQ ID NO: 875957 - protein, 607 aa, Homo sapiens; identical to SEQ ID NO: 875954

SEQ ID NO: 875958 - protein, 38 aa, Homo sapiens
GRPTKQDKELAVVLEPRVGFQQGEAFLPGVIQEVQGKV

SEQ ID NO: 875959 - protein, 728 aa, Homo sapiens
MSESGEMSEFGYIMELIAKGKVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVNFYDMDQMKCLYERQVDCSHTLYPAFALMGSGGIQLEEPITAKYLEYQEDM

SEQ ID NO: 875960 - protein, 148 aa, Homo sapiens
CRHAIKAGECLAGAALSRVRTRFVCAFVCLRCGPNRCRDPRGGGASARPAPPGEGFTASAAAAAALVCSVRSRSPDRCTRILASRARLPGSPRWPSFHPSPLLAFPGASPLFLVNSLWAGSSAKLRLKTEKEKRKDKFDTPASVLQSL

SEQ ID NO: 875961 - protein, 148 aa, Homo sapiens; identical to SEQ ID NO: 875960

SEQ ID NO: 875962 - protein, 726 aa, Homo sapiens
MEGDGSDSPVTIKNIERELICPACKELFTHPLILPCQHSICHKCVKELLLTLDDSFNDVGSDNSNQSSPRLRLPSPSMDKIDRINRPASQRRSVGWRGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVNFYDMDQMKCLYERQVDCSHTLYPAFALMGSGGIQLEEPITAKYLEYQEDM

SEQ ID NO: 875963 - protein, 573 aa, Homo sapiens
MCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVNFYDMDQMKCLYERQVDCSHTLYPAFALMGSGGIQLEEPITAKYLEYQEDM

SEQ ID NO: 875964 - protein, 133 aa, Homo sapiens
MSESGEMSEFGYIMELIAKGKVSDEARGAAAWAPDSGTTWPATVGVRVHSSAWEGREAGIQEPRRSPGVPAAAECKVAAFSLLRGISEISQEGTFGRFWGQLGSNRGSRTPKGESPASEDGEEGGALAKGALP

SEQ ID NO: 875965 - protein, 148 aa, Homo sapiens; identical to SEQ ID NO: 875960

SEQ ID NO: 875966 - protein, 716 aa, Homo sapiens [sequence omitted]

SEQ ID NO: 875967 - protein, 810 aa, Homo sapiens
MVARHFGRPRWEDHLRSGVRDQPGQHGCQRSEGKPAVTGLTQLPHSPKGQSHFHCTPNNSTKFVSRQWVSRAENLPQSTRLPAAKASMAFLLPPVESAHWIYTLPQVVARRLLHQFKLLQTLAGGFLLPVAFSQSLWPFSGRTPVRPGKNDLMGAQELPGVFPLLPLPLYFTQLSKLTQPPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVNFYDMDQMKCLYERQVDCSHTLYPAFALMGSGGIQLEEPITAKYLEYQEDM

SEQ ID NO: 875968 - protein, 655 aa, Homo sapiens
MVARHFGRPRWEDHLRSGVRDQPGQHGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVNFYDMDQMKCLYERQVDCSHTLYPAFALMGSGGIQLEEPITAKYLEYQEDM

SEQ ID NO: 875969 - protein, 44 aa, Homo sapiens
SFSFGNLQVARWSGDGDEGEELAVAPSHGLCITNSPFLFPQNTL

SEQ ID NO: 875970 - protein, 88 aa, Homo sapiens
ARSRPAVGPPSFLPPAWTTVFRLNCGASPTVSPHRHLRGNRRSATSSCPPSWGDGQKSRARSLSRRTPGNRSRLIAGNCDKSSVGYWS

SEQ ID NO: 875971 - protein, 73 aa, Homo sapiens
ARSRPAVGPPSFLPPAWTTVFRLNCGASPTVSPHRHLRGNRRSATSSCPPSWGDGQKSRARSLSRRTPGNSSY

SEQ ID NO: 875972 - protein, 73 aa, Homo sapiens
ARSRPAVGPPSFLPPAWTTVFRLNCGASPTVSPHRHLRGNRRSATSSCPPSWGDGQKSRARSLSRRTPGNSTH

SEQ ID NO: 875973 - protein, 73 aa, Homo sapiens; identical to SEQ ID NO: 875971

SEQ ID NO: 875974 - protein, 76 aa, Homo sapiens
RQPLTSSLSSPPQFVEVEGQITSLVDLYPSFLRKGYRREIFIAFVCSISYLLGLTMVTEGGTYVFPDNLPHYGILR

SEQ ID NO: 875975 - protein, 620 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 875976 - protein, 506 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 875977 - protein, 200 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWE

SEQ ID NO: 875978 - protein, 258 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVFIRRIHGTSVKSIQGRFQRIPPISSHQT

SEQ ID NO: 875979 - protein, 620 aa, Homo sapiens; identical to SEQ ID NO: 875975

SEQ ID NO: 875980 - protein, 620 aa, Homo sapiens; identical to SEQ ID NO: 875975

SEQ ID NO: 875981 - protein, 182 aa, Homo sapiens
MYHLVYSWNKAFIKHVSFIRSLTDWSACDDGVVASPFEFCIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 875982 - protein, 200 aa, Homo sapiens; identical to SEQ ID NO: 875977

SEQ ID NO: 875983 - protein, 177 aa, Homo sapiens [sequence omitted]

SEQ ID NO: 875984 - protein, 130 aa, Homo sapiens
RRWNFSLHFSSCFFPPATFSASFAVSANPPSTLYFAICLRLSLNLLFSFKIFLFLLPRSPSLFLHTFTWKELGSDVHKQNTFSVGCYLARKNTGCQETEYRKPRKTRPWLEAQNCQHQPPSSRKGTGAGD

SEQ ID NO: 875985 - protein, 400 aa, Homo sapiens
AWFPGRPPLASPLEACGLRRRAGFGGVRASGAMGTPPGLQTDCEALLSRFQETDSVRFEDFTELWRNMKFGTIFCGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 875986 - protein, 123 aa, Homo sapiens [sequence omitted]

SEQ ID NO: 875987 - protein, 375 aa, Homo sapiens
VFTKGQVTTGQYRMLAKRGGYVWVETQATVIYNTKNSQPQCIVCVNYVVSGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 875988 - protein, 124 aa, Homo sapiens
RFLLKWLQGRRRGVRPVRVPCGLQPRRPGPAGLSSRRRRRLDGGQSHAASSARRGRQAGPVPPGETAPGIKERLASETTRQKGRPQMTLGGRLPGLRCSVPGGAARLSTPPQVRQHVFWAASVC

SEQ ID NO: 875989 - protein, 133 aa, Homo sapiens
MKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFT

SEQ ID NO: 875990 - protein, 299 aa, Homo sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 875991 - protein, 350 aa, Homo sapiens
GRAWVTSGSRAILGCAVLCRTRPQPGPGIPIPLGSLSLGPLHPHPSLSLRAMGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 875992 - protein, 358 aa, Homo sapiens
WQGLGYLGLPRNFGMCSPVSDTPAAWTRDPHPPRISEPRASAPTSKAAASVPPSLSLRAMGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 875993 - protein, 100 aa, Homo sapiens
AAAEGRGGSVGLTAGLRRRQRLSLPASRSAPWAGPGLCWPHSGRWKPPGPPRFASEPSTFRASVTAKCRTPLAAASSRRWGPGRGGAAFRGADRADPRTR

SEQ ID NO: 875994 - protein, 299 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 875995 - protein, 226 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 875996 - protein, 203 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLGLTKDGSNENIDSLEEVLNILAEESSDWFYGFLSFLYDIMTPFEMLEEEEEESETADGVDGTSQNEGVQGKTCVILDLHNQ

SEQ ID NO: 875997 - protein, 130 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGRQVHILCFLLVVIKCWKQLFLL

SEQ ID NO: 875998 - protein, 139 aa, Homo sapiens
ICSCRWFDLVDYEEVLGKLGIYDADGDGDFDVDDAKVLLGETKHGGHKNGRKGGLSGTSFFTWFMVIALLGVWTSVAVVWFDLVDYEEVLAKAKDFRYNLSEVLQGKLGIYDADGDGDFDVDDAKVLLETKHGGHNGEE

SEQ ID NO: 875999 - protein, 111 aa, Homo sapiens
LAALPGPPEDNPVEDSQVIVEEVSIFPVEEQQEVPPETNRKTDDPEQKAKGVKKKKPKLLNKFDKTIKAELDAAEKLRKRGKIEEAVNAFKELVRKYPQSPRARYGKAQVF

SEQ ID NO: 876000 - protein, 798 aa, Homo sapiens
RGILCCSRNSPPPPAAPASRVYPRALKEVHQPSPAPADRAMAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876001 - protein, 758 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876002 - protein, 739 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDTQKILVDSREATSVPHIYAIGDVVEGRPELTPTAIMAGSESVGADMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876003 - protein, 637 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPE

SEQ ID NO: 876004 - protein, 729 aa, Homo sapiens
MAEDKETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876005 - protein, 701 aa, Homo sapiens
LAALPGPPEDNPVEDSQVIVEEVSIFPVEEQQEVPPETNRKTDDPEQKAKGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876006 - protein, 701 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876007 - protein, 66 aa, Homo sapiens
PKTRPRSQEPMQKQKNLTWEEGKVLIFDDSFEHEVWQDASSFRLIFIVDVWHPELTPQQRRSLPAI

SEQ ID NO: 876008 - protein, 313 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 876009 - protein, 294 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPDT

SEQ ID NO: 876010 - protein, 207 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHER

SEQ ID NO: 876011 - protein, 270 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 876012 - protein, 109 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGR

SEQ ID NO: 876013 - protein, 104 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADSLMGCYAVMGG

SEQ ID NO: 876014 - protein, 133 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLETKHGGHNGEE

SEQ ID NO: 876015 - protein, 210 aa, Homo sapiens
MAEDKETKHGGHKNGRKGGLSGTSFFTWFMVIALLGVWTSVAVVWFDLVDYEEVLGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 876016 - protein, 226 aa, Homo sapiens; identical to SEQ ID NO: 875995

SEQ ID NO: 876017 - protein, 174 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLTKDGSNENIDSLEEVLNILAEESSDWFYGFLSFLYDIMTPFEMLEEEEEESETADGVDGTSQNEGVQGKTCVILDLHNQ

SEQ ID NO: 876018 - protein, 758 aa, Homo sapiens; identical to SEQ ID NO: 876001

SEQ ID NO: 876019 - protein, 758 aa, Homo sapiens; identical to SEQ ID NO: 876001

SEQ ID NO: 876020 - protein, 739 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876021 - protein, 382 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKARNICLAAIHLGNTLLCVIS

SEQ ID NO: 876022 - protein, 784 aa, Homo sapiens
RGILCCSRNSPPPPAAPASRVYPRALKEVHQPSPAPADRAMAQRKNAKSSGNSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876023 - protein, 773 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 876024 - protein, 86 aa, Homo sapiens
GPAVCGPVCGTNCRLRMHLGLVIPKEGCKIRCANETKTWEEGKVLIFDDSFEHEVWQDASSFRLIFIVDVWHPELTPQQRRSLPAI

SEQ ID NO: 876025 - protein, 704 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKYGSSVIRHIRHLRG

SEQ ID NO: 876026 - protein, 264 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYENWR

SEQ ID NO: 876027 - protein, 114 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGRLLELHFKSTCVTL

SEQ ID NO: 876028 - protein, 202 aa, Homo sapiens
ICSCRWFDLVDYEEVLGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 876029 - protein, 206 aa, Homo sapiens
RAAAPRVRPPPAPIQQPRRSHTAGQTRPRRVPARSSPAQPSPGTGRPGGRPAPEGAGRGGRMPKPTLLLRGGWERERSPGDSELGRQFRDWCLRTYGDSAKTKTVTRSKYQRIAEVLQGGGGTGAGSGPAAGEKGKFQFWVRSKGFRLGSGREPKMGQVVYVPVKTGSLCSIQFYGCTIIYLSSPLLMDIWIVYDILLSQDFSEHP

SEQ ID NO: 876030 - protein, 68 aa, Homo sapiens
SPAFWQYQGADPGMGCSVTAVPPMSGRGQQNTLIGRASREPEDNQSLKMQSTHENVFKDHDSVHQGDI

SEQ ID NO: 876031 - protein, 130 aa, Homo sapiens
FIQKVQHGLLEKEICSESLSTAEGTCSAEELAVRSFSWGLGGTCEQSGRHTQWEPVRAPVHLQELRTEGVGLHGGHVGVGTEKGHRSETETDRTSYPAEPCREPLRLSALILSSVRKFPLSQGNHVKPMK

SEQ ID NO: 876032 - protein, 108 aa, Homo sapiens
NLPGRESPLHTQFASLQLTAGAKNVASQVGRVTTDGGMEPPSAWGQPRLLITGQVFRSDVHHSHGLFVCQGLGPGYECSKIEQEVQKKAEAKRRLQHGRAGLGERIYL

SEQ ID NO: 876033 - protein, 342 aa, Homo sapiens
TQRGPGLHGRAATLPPGDGAACPARLSPGCRRLGQHHQVSLEGKGWSDLPHVPSSDPSLKSAPGHPACGSASPAPRCHLLRAGQQAPERPQTRGAAQPTTVTSGASGAQRCWAGLGHDREHAQSARFAHRARAHTCSAPTLRAAAGFRHARHGGGPGRLWPRPSVTRRESPDQAAELRRYKGSGYRQSRIRRRSSRRPREPPGPSRRRRRRRPDPRTMPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 876034 - protein, 165 aa, Homo sapiens
ARRGGQGSTGERRPCLPETARPALRASAPGAGVSGSTTKSLWRGKDGRICPMSLPLTPPSRVPRDTPPVAQPPPPRAAISSGPGSRLPSAHRPGVRPSPQPSPQGPQAPSGAGRGWGTTGSMRRARVSPIAHAHTPAPPPRCVPLLGSATPVMAAAPAGSGPAPR

SEQ ID NO: 876035 - protein, 159 aa, Homo sapiens
MSTASIADRIARERPREPPGPSRRRRRRRPDPRTMPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 876036 - protein, 342 aa, Homo sapiens; identical to SEQ ID NO: 876033

SEQ ID NO: 876037 - protein, 342 aa, Homo sapiens; identical to SEQ ID NO: 876033

SEQ ID NO: 876038 - protein, 342 aa, Homo sapiens; identical to SEQ ID NO: 876033

SEQ ID NO: 876039 - protein, 342 aa, Homo sapiens; identical to SEQ ID NO: 876033

SEQ ID NO: 876040 - protein, 351 aa, Homo sapiens
TQRGPGLHGRAATLPPGDGAACPARLSPGCRRLGQHHQVSLEGKGWSDLPHVPSSDPSLKSAPGHPACGSASPAPRCHLLRAGQQAPERPQTRGAAQPTTVTSGASGAQRCWAGLGHDREHAQSARFAHRARAHTCSAPTLRAAAGFRHARHGGGPGRLWPRPSVTRRESPDQAAELRRYKGSGYRQSRIRRRSSRRPREPPGPSRRRRRRRPDPRTMPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKCRRGREFSSSSR

SEQ ID NO: 876041 - protein, 165 aa, Homo sapiens; identical to SEQ ID NO: 876034

SEQ ID NO: 876042 - protein, 342 aa, Homo sapiens; identical to SEQ ID NO: 876033

SEQ ID NO: 876043 - protein, 342 aa, Homo sapiens; identical to SEQ ID NO: 876033

SEQ ID NO: 876044 - protein, 100 aa, Homo sapiens
RGGVPAVPRPPPPPQARCGRGSRFWGPTAPGAALGRSALKRGCAGTQRVTFRAGFPVEGARPGASASYRPQCLGREEGNVLGPGLAAPGTAHSGVASSCL

SEQ ID NO: 876045 - protein, 342 aa, Homo sapiens; identical to SEQ ID NO: 876033

SEQ ID NO: 876046 - protein, 342 aa, Homo sapiens; identical to SEQ ID NO: 876033

SEQ ID NO: 876047 - protein, 326 aa, Homo sapiens
TQRGPGLHGRAATLPPGDGAACPARLSPGCRRLGQHHQVSLEGKGWSDLPHVPSSDPSLKSAPGHPACGSASPAPRCHLLRAGQQAPERPQTRGAAQPTTVTSGASGAQRCWAGLGHDREHAQSARFAHRARAHTCSAPTLRAAAGFRHARHGGGPGRLWPRPSVTRRESPDQAAELRRYKGSGYRQSRIRRRSSRRPREPPGPSRRRRRRRPDPRTMPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKLNVLLK

SEQ ID NO: 876048 - protein, 134 aa, Homo sapiens
MVPGLCRTQRCGWPWARWQWLLEDDREHVGGGRVEPTMSGNSLGAQETKLEVAPLSPPCTQCHLCGGPVRPPQFTGVAVTTPEITFKKEARAGACRSQEAEVHPECPGTGQPGGVHGPTVPTTASEMGREHAWF

SEQ ID NO: 876049 - protein, 37 aa, Homo sapiens
VFPSIVGHPRHQGVMVGMGQKDSYVGDEAQSKRGILT

SEQ ID NO: 876050 - protein, 91 aa, Homo sapiens
GRRDKGTRSEAEEERCIPEAEPAVMGLDYGGGRGRGEKGQNRTQCAASGLGRWTECGARERCHGDARAWMKPGGLTVSMVHTSVGSEGHLL

SEQ ID NO: 876051 - protein, 658 aa, Homo sapiens [sequence omitted]

SEQ ID NO: 876052 - protein, 491 aa, Homo sapiens [sequence omitted]

SEQ ID NO: 876053 - protein, 478 aa, Homo sapiens
THASGPTRRGRVGRPTRAENMVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 876054 - protein, 398 aa, Homo sapiens
MMQETISPITGRVLTLEKQAIQQQLRGRALKCSVFITPKFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 876055 - protein, 658 aa, Homo sapiens [sequence omitted]

SEQ ID NO: 876056 - protein, 658 aa, Homo sapiens [sequence omitted]

SEQ ID NO: 876057 - protein, 658 aa, Homo sapiens [sequence omitted]

SEQ ID NO: 876058 - protein, 264 aa, Homo sapiens
PTRPDPRVADAWVDPRVAENNCSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 876059 - protein, 106 aa, Homo sapiens [sequence omitted]

SEQ ID NO: 876060 - protein, 637 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKLGMPFTIIGGREKEGFDFATVAFNEFELLLI

SEQ ID NO: 876061 - protein, 521 aa, Homo sapiens
MLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAALGGALGVFRLGGIGHLGRVGPWAGPGPGWGLRGGLGCGRFN

SEQ ID NO: 876062 - protein, 424 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGLKADVMSWSRLS

SEQ ID NO: 876063 - protein, 32 aa, Homo sapiens
MWNTGIITRWSRRKKQRGPQHNGAWRFSPQFK

SEQ ID NO: 876064 - protein, 322 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQVNLFPFNVLLSVKGKLKIQSSV

SEQ ID NO: 876065 - protein, 356 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIFKYSL

SEQ ID NO: 876066 - protein, 491 aa, Homo sapiens [sequence omitted]

SEQ ID NO: 876067 - protein, 658 aa, Homo sapiens [sequence omitted]

SEQ ID NO: 876068 - protein, 658 aa, Homo sapiens [sequence omitted]

SEQ ID NO: 876069 - protein, 658 aa, Homo sapiens [sequence omitted]

SEQ ID NO: 876070 - protein, 687 aa, Homo sapiens
MLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGWSRRLGRKLTLAWSPCCVSFNEVLFLYSGPFRFVDLYGAQKIVDRLKKYEAAYGKQFTPCQLLADHANSPNKKFYQ

SEQ ID NO: 876071 - protein, 658 aa, Homo sapiens [sequence omitted]

SEQ ID NO: 876072 - protein, 658 aa, Homo sapiens [sequence omitted]

SEQ ID NO: 876073 - protein, 658 aa, Homo sapiens [sequence omitted]

SEQ ID NO: 876074 - protein, 74 aa, Homo sapiens
RWLSRGSLTAGETSERLGLGFPPCLGGPFRFVDLYGAQKIVDRLKKYEAAYGKQFTPCQLLADHANSPNKKFYQ

SEQ ID NO: 876075 - protein, 600 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGSGFEGEPKNVKQRVKVF

SEQ ID NO: 876076 - protein, 555 aa, Homo sapiens
MLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKCFYSLKLIRRNI

SEQ ID NO: 876077 - protein, 382 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKG

SEQ ID NO: 876078 - protein, 337 aa, Homo sapiens
MPQFYRVFCLLTRTHINYGVKGDVAVFRINSPNSKVNTLSKELHSEFSEVMNEIWASDQIRSAVLISSKPGCLCKGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVK

SEQ ID NO: 876079 - protein, 75 aa, Homo sapiens
QKRMHFNSNGLEPKENEPPSPLVSGIIDYNMPLTSTYLKQMKLRVMNSQEQPSSLSPAPGFVNTVITVLICAHEE

SEQ ID NO: 876080 - protein, 491 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876081 - protein, 491 aa, Homo sapiens; identical to SEQ ID NO: 876080

SEQ ID NO: 876082 - protein, 507 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKNNGSINPLLRLLYSQQGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876083 - protein, 266 aa, Homo sapiens
MEKQWQINPLLRLLYSQQGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876084 - protein, 480 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVFPNTEENLRSLFVFCLKWLDFILQPPYLFCSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876085 - protein, 387 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSGMRP

SEQ ID NO: 876086 - protein, 491 aa, Homo sapiens; identical to SEQ ID NO: 876080

SEQ ID NO: 876087 - protein, 491 aa, Homo sapiens; identical to SEQ ID NO: 876080

SEQ ID NO: 876088 - protein, 422 aa, Homo sapiens
MKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876089 - protein, 325 aa, Homo sapiens
MVIVQVQLSEFTVHLHRMFTMTEGKLFVVVKRKNRIKEERKRDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 876090 - protein, 124 aa, Homo sapiens
NQLEKTAIKIQSWWRGNMVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 876091 - protein, 102 aa, Homo sapiens
ELLQGKKSVLKLLCVHTQQPGFLEGHFPHCALWMIIPGIRCEALHPHPGAIKSLCKRRSWTQAGMQGCDLGSMQPLPPRIQAILLPQLLEYLGLQAPATTPD

SEQ ID NO: 876092 - protein, 69 aa, Homo sapiens
MMVLTPFWLGRDCPSRGQPTLREGKGLSVPFTCKLNNPQRYLLYLTHTPRRQYSPAWYLPGKLGITLTV

SEQ ID NO: 876093 - protein, 586 aa, Homo sapiens
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 876094 - protein, 613 aa, Homo sapiens
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVFSKIRAYCLDTLKKNSDNTSLLFNHEVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 876095 - protein, 427 aa, Homo sapiens
MEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 876096 - protein, 586 aa, Homo sapiens; identical to SEQ ID NO: 876093

SEQ ID NO: 876097 - protein, 586 aa, Homo sapiens; identical to SEQ ID NO: 876093

SEQ ID NO: 876098 - protein, 540 aa, Homo sapiens
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 876099 - protein, 238 aa, Homo sapiens
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVAILKDLE

SEQ ID NO: 876100 - protein, 150 aa, Homo sapiens
MSLLATLGLELDRALLPASGLGWLVDYGKLPPAPAPLAPYEVLGGALEGGLPVGGEPLAGDGFSDWMTERVDFTALLPLEPPTVYKREPKGENSKKERQQREEKTQQTTQKQNKKKRETKKGTPEETQSGDEKNKKKKEQHHKTHKPENK

SEQ ID NO: 876101 - protein, 115 aa, Homo sapiens
MSLLATLGLELDRALLPASGLGWLVDYGKLPPAPAPLAPYEVLGGALEGGLPVGGEPLAGDGFSDWMTERVDFTALLPLEPPSGRPSPHNKGKKGNQKREEREKGKGSTKRTTQE

SEQ ID NO: 876102 - protein, 282 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 876103 - protein, 282 aa, Homo sapiens; identical to SEQ ID NO: 876102

SEQ ID NO: 876104 - protein, 282 aa, Homo sapiens; identical to SEQ ID NO: 876102

SEQ ID NO: 876105 - protein, 282 aa, Homo sapiens; identical to SEQ ID NO: 876102

SEQ ID NO: 876106 - protein, 282 aa, Homo sapiens; identical to SEQ ID NO: 876102

SEQ ID NO: 876107 - protein, 282 aa, Homo sapiens; identical to SEQ ID NO: 876102

SEQ ID NO: 876108 - protein, 282 aa, Homo sapiens; identical to SEQ ID NO: 876102

SEQ ID NO: 876109 - protein, 282 aa, Homo sapiens; identical to SEQ ID NO: 876102

SEQ ID NO: 876110 - protein, 282 aa, Homo sapiens; identical to SEQ ID NO: 876102

SEQ ID NO: 876111 - protein, 282 aa, Homo sapiens; identical to SEQ ID NO: 876102

SEQ ID NO: 876112 - protein, 282 aa, Homo sapiens; identical to SEQ ID NO: 876102

SEQ ID NO: 876113 - protein, 282 aa, Homo sapiens; identical to SEQ ID NO: 876102

SEQ ID NO: 876114 - protein, 282 aa, Homo sapiens; identical to SEQ ID NO: 876102

SEQ ID NO: 876115 - protein, 196 aa, Homo sapiens
LSSVSAYHLSAYFWISSLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 876116 - protein, 145 aa, Homo sapiens
MIREGRAPPPSIYLSPVPGAASFPVLGSQSLSSLQCRRLCLRSPGHGSVASTPLCPRPVSALTTPALSAPTFFLQPRPPPPLLAAAMESSTFALVPVFAHLSILQSLVPAAGAASPVAISAQHLCYSHVTPGDPGAGAGQGPAPS

SEQ ID NO: 876117 - protein, 188 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPPKKKQQLKENHCPPPPPPGLVALFWGFPLCRTGRAGAWGPAQPSVLLSPSAPGGGPPPPPLGFRPPA

SEQ ID NO: 876118 - protein, 115 aa, Homo sapiens
MSLLATLGLELDRALLPASGLGWLVDYGKLPPAPAPLAPYEVLGGALEGGLPVGGEPLAGDGFSDWMTERVDFTALLPLEPPTGRPSPHNKGKKGNQKREEREKGKGSTKRTTQE

SEQ ID NO: 876119 - protein, 145 aa, Homo sapiens; identical to SEQ ID NO: 876116

SEQ ID NO: 876120 - protein, 117 aa, Homo sapiens
MERSSLQCRRLCLRSPGHGSVASTPLCPRPVSALTTPALSAPTFFLQPRPPPPLLAAAMESSTFALVPVFAHLSILQSLVPAAGAASPVAISAQHLCYSHVTPGDPGAGAGQGPAPS

SEQ ID NO: 876121 - protein, 282 aa, Homo sapiens; identical to SEQ ID NO: 876102

SEQ ID NO: 876122 - protein, 282 aa, Homo sapiens; identical to SEQ ID NO: 876102

SEQ ID NO: 876123 - protein, 282 aa, Homo sapiens; identical to SEQ ID NO: 876102

SEQ ID NO: 876124 - protein, 142 aa, Homo sapiens
MPRPLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 876125 - protein, 282 aa, Homo sapiens; identical to SEQ ID NO: 876102

SEQ ID NO: 876126 - protein, 282 aa, Homo sapiens; identical to SEQ ID NO: 876102

SEQ ID NO: 876127 - protein, 231 aa, Homo sapiens [sequence omitted]

SEQ ID NO: 876128 - protein, 282 aa, Homo sapiens; identical to SEQ ID NO: 876102

SEQ ID NO: 876129 - protein, 191 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSPSLLQLLFFIFISIYRRAGGIRFPHRAPPPLHSTSRWPLPHLHTEGR

SEQ ID NO: 876130 - protein, 145 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPAYYQPLCLVVNAPHLIRLFIYFLP

SEQ ID NO: 876131 - protein, 96 aa, Homo sapiens
GMKVLSDRRCVSSHHPRSRQTRCGMKVLGDRRCVSSDHPTSRQTCCGMKVLSDRCSVAYDHPRSRQTLCGMKVLGDRRSVASISSYPSERPTSPLW

SEQ ID NO: 876132 - protein, 79 aa, Homo sapiens
TWSSHSEMTRATPLETWGILEQGFQGNEGRESSLDFFLLQMRRRQLPGVSTSEKATESWADKVSLCGYSSLQPQIPALK

SEQ ID NO: 876133 - protein, 79 aa, Homo sapiens; identical to SEQ ID NO: 876132

SEQ ID NO: 876134 - protein, 772 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGHV

SEQ ID NO: 876135 - protein, 773 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKS

SEQ ID NO: 876136 - protein, 730 aa, Homo sapiens
MDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKS

SEQ ID NO: 876137 - protein, 628 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKERLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKS

SEQ ID NO: 876138 - protein, 772 aa, Homo sapiens; identical to SEQ ID NO: 876134

SEQ ID NO: 876139 - protein, 772 aa, Homo sapiens; identical to SEQ ID NO: 876134

SEQ ID NO: 876140 - protein, 772 aa, Homo sapiens; identical to SEQ ID NO: 876134

SEQ ID NO: 876141 - protein, 792 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWMLPLRRDWRDSWQGRPTGNLSIPQSTPSHPSYNALFKALSR

SEQ ID NO: 876142 - protein, 406 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTREDMYKGGKS

SEQ ID NO: 876143 - protein, 399 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCRFPRSWWTVAPERRRYTCR

SEQ ID NO: 876144 - protein, 359 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQACPRAQAGKGPPGRGTFPRVMGDFKAGPRGA

SEQ ID NO: 876145 - protein, 210 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEKKKKKQKKFFGGLGLREKFSKHLCALGPAGPNVGKRRTPGPIGLGPPKEEPGDKDQGGGISHPIKKAPGGTHPAVFWHNSEKGRRRGNNGITQRGCQEAK

SEQ ID NO: 876146 - protein, 773 aa, Homo sapiens; identical to SEQ ID NO: 876135

SEQ ID NO: 876147 - protein, 586 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKRGSETWSSLPVWKTVFSWQQMWQLGVWIFLKSSMSSITRSHVPRRFMSTEVVELLELPMKASV

SEQ ID NO: 876148 - protein, 523 aa, Homo sapiens
MIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKS

SEQ ID NO: 876149 - protein, 482 aa, Homo sapiens
RSHEASRVIGRGYRECYMPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKS

SEQ ID NO: 876150 - protein, 772 aa, Homo sapiens; identical to SEQ ID NO: 876134

SEQ ID NO: 876151 - protein, 748 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPGEHILVCARANRELDNWKRYVRLRDPGYTHHL

SEQ ID NO: 876152 - protein, 598 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKEGRKEGKEGGKEGRRELVPILWL

SEQ ID NO: 876153 - protein, 546 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSHPCVSLHHQPQVKKSPSLPLTPIAGETSCRFALFWSKNSMQQLNFSVLQCL

SEQ ID NO: 876154 - protein, 392 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELVKGPCRFQVSVAVDHRAPA

SEQ ID NO: 876155 - protein, 194 aa, Homo sapiens
PGSGSGGRAMWLLGPLCLLLSSAAAKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYN

SEQ ID NO: 876156 - protein, 51 aa, Homo sapiens
MDGASRAPGSVTGCLTASTRVMRRSAVSGLALCWGGVAAILGQRGAGPEQA

SEQ ID NO: 876157 - protein, 234 aa, Homo sapiens
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYN

SEQ ID NO: 876158 - protein, 114 aa, Homo sapiens
NYDSEILLLSRVITKGSSLRAPCDSGGEVDHDLGGNVCSLFPLLEFCHRIMESTSQDRRATHVITIKPNETVLTAFPYRPHSSLLDFLKGEPRVLGATQILLALISGLWNYICT

SEQ ID NO: 876159 - protein, 537 aa, Homo sapiens
MIRGSASSGFEPSPVLFFLPSDVTQNSEQPAPEEYDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDRQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 876160 - protein, 732 aa, Homo sapiens
MNVISSLVAITGITFTILSYRHQDKYCQMPSFEEICVFSRTLFIVLFFLPSDVTQNSEQPAPEEYDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDRQVKDQQTDKEQNSKKQTQDQQTEDQPAQEKKSPKGQFQNVQAEGQQAQVEKVPKLLCQDSESQIQQIPILAIPQRQSPGWTTQDCQSFGQESPDWITQGWRNKDYKAREWQFEMKHWQTQDLLEKEALKQKALYQEVQTQHATAQHNLECQDTQDKDQQDLQSRVTQKGDMYTRDIKPGDMKCIGQTSGDLQSEDVKADFHSSSGQSSVQDTCLAYLSNLDSEQDVQPDTSASSNSYKEDVNLTSTSCDPKDQQQSEDSD

SEQ ID NO: 876161 - protein, 736 aa, Homo sapiens
NPAALNPASLQCKLDEKDDTILSYRHQDKYCQMPSFEEICVFSRTLFIVLFFLPSDVTQNSEQPAPEEYDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDRQVKDQQTDKEQNSKKQTQDQQTEDQPAQEKKSPKGQFQNVQAEGQQAQVEKVPKLLCQDSESQIQQIPILAIPQRQSPGWTTQDCQSFGQESPDWITQGWRNKDYKAREWQFEMKHWQTQDLLEKEALKQKALYQEVQTQHATAQHNLECQDTQDKDQQDLQSRVTQKGDMYTRDIKPGDMKCIGQTSGDLQSEDVKADFHSSSGQSSVQDTCLAYLSNLDSEQDVQPDTSASSNSYKEDVNLTSTSCDPKDQQQSEDSD

SEQ ID NO: 876162 - protein, 732 aa, Homo sapiens; identical to SEQ ID NO: 876160

SEQ ID NO: 876163 - protein, 114 aa, Homo sapiens; identical to SEQ ID NO: 876158

SEQ ID NO: 876164 - protein, 570 aa, Homo sapiens
MIRGSASSGFEPSPGILLILLIISIAELSISVTIASFRSKCWTQSDEVLFFLPSDVTQNSEQPAPEEYDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDRQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 876165 - protein, 537 aa, Homo sapiens; identical to SEQ ID NO: 876159

SEQ ID NO: 876166 - protein, 732 aa, Homo sapiens; identical to SEQ ID NO: 876160

SEQ ID NO: 876167 - protein, 114 aa, Homo sapiens
LEIKPGSSSKGELEVGSTVEVRVSYVENPGYFWCQLTRNIQGLKTLMSDIQYYCKNTAAPHQRNTLACLAKRTVNRQWSRALISGIQSVEHVNVTFVDYGDREMVSVKNIYSIS

SEQ ID NO: 876168 - protein, 88 aa, Homo sapiens
SWNTARTQTRMMGPCSKQPDRSNGHQQVKGIAAPGLKPGPQENTTSEAGLPQGEARTRDDGDEEGLLTHSEEELEHSQDTDADDGALQ

SEQ ID NO: 876169 - protein, 126 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDR

SEQ ID NO: 876170 - protein, 114 aa, Homo sapiens
EYTARKSWNTARTQTRMMGPCSKQPDRSNGHQQVKGIAAPRPQAGHPTLDATPQRVPEESWQQARHQPPQENTTSEAGLPQGEARTRDDSDEEGLLTHSEEELEHIQDTTALVY

SEQ ID NO: 876171 - protein, 291 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876172 - protein, 472 aa, Homo sapiens
SGPFQSQAERVGRAHAPGKPGCFWAGLQTPRARVTVSFPGDREGGEPGTRAGAAGGAELRGAAPGAPTPARLSGAGRGQGSRLRGSRRCQCGGARERRQLGAAEPREAEGAVAAATATTTTPARVPSLFPPQPPFSSLPYVPECGSTASFPAARLPPDLSARVGTMSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876173 - protein, 307 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876174 - protein, 130 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSQGGPCEATPGHSPFGPACQN

SEQ ID NO: 876175 - protein, 270 aa, Homo sapiens
MSPCAQNSRHTAYLEKMVSNERHARPAPAHFSPSTAARAWRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876176 - protein, 251 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGSSGGVCCLCFFFCFVFDIGLFS

SEQ ID NO: 876177 - protein, 307 aa, Homo sapiens; identical to SEQ ID NO: 876173

SEQ ID NO: 876178 - protein, 192 aa, Homo sapiens
MLQPLAHLPYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876179 - protein, 307 aa, Homo sapiens; identical to SEQ ID NO: 876173

SEQ ID NO: 876180 - protein, 204 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTRTQPGHRRG

SEQ ID NO: 876181 - protein, 319 aa, Homo sapiens [sequence omitted]

SEQ ID NO: 876182 - protein, 274 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGVVRGGRQRHTPETHLRGSREHGRRRKEGARE

SEQ ID NO: 876183 - protein, 123 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSYIFDYDYWPTPSP

SEQ ID NO: 876184 - protein, 164 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSYIFDYDYSCHHDPGHNMIISTLAETNRTPFDLPEGESELVIRLEHRNAEINRAE

SEQ ID NO: 876185 - protein, 439 aa, Homo sapiens
SGPFQSQAERVGRAHAPGKPGCFWAGLQTPRARVTVSFPGDREGGEPGTRAGAAGGAELRGAAPGAPTPARLSGAGRGQGSRLRGSRRCQCGGARERRQLGAAEPREAEGAVAAATATTTTPARVPSLFPPQPPFSSLPYVPECGSTASFPAARLPPDLSARVGTMSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGVVRGGRQRHTPETHLRGSREHGRRRKEGARE

SEQ ID NO: 876186 - protein, 172 aa, Homo sapiens
SGPFQSQAERVGRAHAPGKPGCFWAGLQTPRARVTVSFPGDREGGEPGTRAGAAGGAELRGAAPGAPTPARLSGAGRGQGSRLRGSRRCQCGGARERRQLGAAEPREAEGAVAAATATTTTPARVPSLFPPQPPFSSLPYVPECGSTASFPAARLPPDLSARVSPIPRGRWC

SEQ ID NO: 876187 - protein, 329 aa, Homo sapiens
SGPFQSQAERVGRAHAPGKPGCFWAGLQTPRARVTVSFPGDREGGEPGTRAGAAGGAELRGAAPGAPTPARLSGAGRGQGSRLRGSRRCQCGGARERRQLGAAEPREAEGAVAAATATTTTPARVPSLFPPQPPFSSLPYVPECGSTASFPAARLPPDLSARVGTMSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSYIFDYDYSCHHDPGHNMIISTLAETNRTPFDLPEGESELVIRLEHRNAEINRAE

SEQ ID NO: 876188 - protein, 307 aa, Homo sapiens; identical to SEQ ID NO: 876173

SEQ ID NO: 876189 - protein, 178 aa, Homo sapiens
MITTGTTSTTARAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDEEGLLTHSEEELEHSQDTDADDGALQ

SEQ ID NO: 876190 - protein, 307 aa, Homo sapiens; identical to SEQ ID NO: 876173

SEQ ID NO: 876191 - protein, 307 aa, Homo sapiens; identical to SEQ ID NO: 876173

SEQ ID NO: 876192 - protein, 291 aa, Homo sapiens; identical to SEQ ID NO: 876171

SEQ ID NO: 876193 - protein, 257 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAFRQAVSTEEKESYRMSAIQNSTLSNPC

SEQ ID NO: 876194 - protein, 307 aa, Homo sapiens; identical to SEQ ID NO: 876173

SEQ ID NO: 876195 - protein, 330 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGASGGGGGGGGSGGGGSGGGGGGGSSRPPAPQENTTSEAGLPQGEARTRDDGDERTGGLPWNTTSRRQELEQQAQGTHKERRGHRNRRALRQNSKPDRSPTG

SEQ ID NO: 876196 - protein, 172 aa, Homo sapiens; identical to SEQ ID NO: 876186

SEQ ID NO: 876197 - protein, 172 aa, Homo sapiens; identical to SEQ ID NO: 876186

SEQ ID NO: 876198 - protein, 172 aa, Homo sapiens; identical to SEQ ID NO: 876186

SEQ ID NO: 876199 - protein, 172 aa, Homo sapiens; identical to SEQ ID NO: 876186

SEQ ID NO: 876200 - protein, 54 aa, Homo sapiens
YYQKRISNWRACYSIAVIGWYGPDWAGECYTNSSQICCLWGHVLEAGYWPTPSP

SEQ ID NO: 876201 - protein, 187 aa, Homo sapiens
SLYPCSCCSCCTEINAEQTDLRYCREYQRGNCNRGENDCRVLLIPADSTMIDTNDNTVTVCMDYIKRGKCFSGKKCKILSTPPATFAKPKIKAAPNTKSNQAAAAQAAATAAAMTQSAVKSLKRPLEATFDLGIPQAVLPPLPKRPALEKTNGATAVFNTGIFQYQQALANMQLQQHTAFLPPGKGW

SEQ ID NO: 876202 - protein, 489 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876203 - protein, 511 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQINTDSFSSYPVFSPVSLDYSSEPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876204 - protein, 489 aa, Homo sapiens; identical to SEQ ID NO: 876202

SEQ ID NO: 876205 - protein, 489 aa, Homo sapiens; identical to SEQ ID NO: 876202

SEQ ID NO: 876206 - protein, 490 aa, Homo sapiens
MARYEAACLIRPRPGCAVKLLLGSMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876207 - protein, 426 aa, Homo sapiens
MGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876208 - protein, 467 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876209 - protein, 358 aa, Homo sapiens
MPSQYPGGQPTYPSQINTDSFSSYPVFSPVSLDYSSEPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876210 - protein, 394 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876211 - protein, 490 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLSASLIASK

SEQ ID NO: 876212 - protein, 462 aa, Homo sapiens
PGPAPGSILRETGLGCDAAAGVRMSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEPLSINNVADVTWP

SEQ ID NO: 876213 - protein, 489 aa, Homo sapiens; identical to SEQ ID NO: 876202

SEQ ID NO: 876214 - protein, 466 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876215 - protein, 426 aa, Homo sapiens; identical to SEQ ID NO: 876207

SEQ ID NO: 876216 - protein, 385 aa, Homo sapiens
MARYEAALLNSAEAGLCCEAAAGVNVIPRLSPNRLPTFPWISCGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876217 - protein, 328 aa, Homo sapiens
MRLVWLDQRLSCVRDKLYVIVWKCESDDQIIHKSLASSEGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876218 - protein, 489 aa, Homo sapiens; identical to SEQ ID NO: 876202

SEQ ID NO: 876219 - protein, 172 aa, Homo sapiens
ELGYLSHSCHVPGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 876220 - protein, 103 aa, Homo sapiens
MYPNFLHHIKLKEIPLPGKKHITVFGSTEGESSDDSLVDLAVGLGVRFIKLGGLSRGERVTKYNRLLTIEEELVQNGTLATSSSSCDARIGGQEQETMTLVKV

SEQ ID NO: 876221 - protein, 324 aa, Homo sapiens
RTRGAAGRAAARGGRGPARGLHGPRLRRPRGLEGTRSAAGAAQRPGPRSTLRKLVFLRSALRAGYIVLLRWPGEVAATSPRLRTPAARLLPLPTGERLEAAKESGSGGAGVGGCLPFNPPQEVVPLSPKAEGPSWGWVRAGGDRSFQSRAEVKEKLEWTFCSGRTSKMCYLRCPILMTTSSCAGSEEKGPKAHQGACPGNQGACVQCSWVSGYLSHCGSPGQEQGPLARSFDLQKSEDMLRKHMEFRKQQDLANILAWQPPEVVRLYNANGICGHDGEGSPVWYHIVGSLDPKGLLLSASKQELLRDSFRSCELLLRECELQSQ

SEQ ID NO: 876222 - protein, 88 aa, Homo sapiens
MEFRKQQDLANILAWQPPELVKTGENNHSYFGLEEQACGIGGCRNSSLQEFLALTISVIGSYVVTPEYTTPPGRHADARQANATLRRP

SEQ ID NO: 876223 - protein, 225 aa, Homo sapiens
MSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 876224 - protein, 258 aa, Homo sapiens
VICMWQGCAVERPVGRMTSQTPLPQSPRPRRPTMSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 876225 - protein, 258 aa, Homo sapiens; identical to SEQ ID NO: 876224

SEQ ID NO: 876226 - protein, 77 aa, Homo sapiens
MPFNCLLIGFCSSFLLLLLPYCPSLVLSGNRSSCWFSEKSQPEVKFKCRIWLLVLILIWRKPAEMLVWLYMVINFYL

SEQ ID NO: 876227 - protein, 167 aa, Homo sapiens
MLHIGTLDKVREEWQSEHIKACEAFEAQECERINFFRNALWLHVNQLSQQCVTSDENWVKPPGAKKKPPPKKKGGLFPPPMYEQVRKSLEMCSIQRDIEYFVNQRKTGQIPPAPIMYENFYSSQKNAVPAGKATGPNLARRGPLPIPKSSPDDPNYSLVDDYSLLYQ

SEQ ID NO: 876228 - protein, 233 aa, Homo sapiens
ARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEMYEQVRKSLEMCSIQRDIEYFVNQRKTGQIPPAPIMYENFYSSQKNAVPAGKATGPNLARRGPLPIPKSSPDDPNYSLVDDYSLLYQ

SEQ ID NO: 876229 - protein, 233 aa, Homo sapiens; identical to SEQ ID NO: 876228

SEQ ID NO: 876230 - protein, 285 aa, Homo sapiens
VPGDYSKRVYQGVRVKHTVKDLLAEKRSGQTSNSRLNGSVSSSQSPFVQMPGSPVTSGYYGVRRSFLSDSDFHNSKQFSNDVYTSSVGKPFPCESSAGQSHAALLEPYFPQEPYGDYRPPALTPNAGSLFSASPLPPLLPPPFPGDPAHFLFRDSWEQTLPDGLSQPDPVSADALLTLPPSTSCLSQLESGSIAQHRGSSWGSSLAGAQSYSLHALEDLHHTPGYPTPPPYPFTPFMTVSNDLPPKVGPLSPDEEADTGSLHDPSPWVKEDGSIAWGSYECRRAY

SEQ ID NO: 876231 - protein, 305 aa, Homo sapiens
RPPADITWSLADPAEAAVPAGSRLLLPAVGPGHAGTYACLAANPRTGRRRRSLLNLTVADLPPGAPQCSVEGGPGDRSLRFRCSWPGGAPAASLQFQVSPKASAPGQCPLCCWRPSPPTPGSAASPSPALLATWWPRVPAQSRRRPPREVLLHPLVAETQLGEAEVALEASGCPPPSRASWAREGRPLAPGGGSRLRLSQDGRKLHIGNFSLDWDLGNYSVLCSGALGAGGDQITLIGPSISSWRLQRARDAAVLTWDVERGALISSFEIQAWPDGPALGQDFHLQGLGLPAHPGASGAVSRGAP

SEQ ID NO: 876232 - protein, 215 aa, Homo sapiens
RGWRRNEKGTPSSFSPFSPQTCPPGPHSAQLKGVPGTAASASAARGPAGPLLPPCSSRSPRRHPRRASVLCAAGGRPRPPPAQRRPHHLPCSPPGGHAYLHSHAGGPPERCCCIRWWQRHSWGRQRWHWRPLVVPHPHGHPGPGKGGPWLQEAGVACGSVKMGGNSTSATSAWIGTWEITPCCAVGRWVLAVTRSPSLDPPYPRGGFREPEMQPC

SEQ ID NO: 876233 - protein, 196 aa, Homo sapiens
MTCPPGPHSAQLKGVPGTAASASAARGPAGPLLPPCSSRSPRRHPRRASVLCAAGGRPRPPPAQRRPHHLPCSPPGGHAYLHSHAGGPPERCCCIRWWQRHSWGRQRWHWRPLVVPHPHGHPGPGKGGPWLQEAGVACGSVKMGGNSTSATSAWIGTWEITPCCAVGRWVLAVTRSPSLDPPYPRGGFREPEMQPC

SEQ ID NO: 876234 - protein, 116 aa, Homo sapiens
MAPPSVPLVLLLVLLLSLAETPASAPAHRGRGGWTLNSAGYLLGPVLHLPQMGDQDGKRETALEILDLWKAIDGLPYSHPPQPSKRNVMETFAKPEIGDLGMLSMKIPKEEDVLKS

SEQ ID NO: 876235 - protein, 103 aa, Homo sapiens
TSAFLSAKLELGSPAPRTLRASPNSKPFCKGDGLAHPRLSSSSSLAGSLSRKRAWSSPPCSPQAVPDPEAQRHKRTSVEPRGAGCSLGAPAGSRCGQAVPNSG

SEQ ID NO: 876236 - protein, 780 aa, Homo sapiens
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 876237 - protein, 211 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876238 - protein, 148 aa, Homo sapiens
GRVGRPTRPPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876239 - protein, 211 aa, Homo sapiens; identical to SEQ ID NO: 876237

SEQ ID NO: 876240 - protein, 284 aa, Homo sapiens
PPAEGQPRGRARRAPGQRALASCALSSGPAPQRPRRRRREGAGQTKEADKGGRSPAAVRAPGEAGPLLPVAGRMTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876241 - protein, 206 aa, Homo sapiens
FFFPFCPQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876242 - protein, 128 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEPSHSFSTP

SEQ ID NO: 876243 - protein, 276 aa, Homo sapiens [sequence omitted]

SEQ ID NO: 876244 - protein, 211 aa, Homo sapiens; identical to SEQ ID NO: 876237

SEQ ID NO: 876245 - protein, 211 aa, Homo sapiens; identical to SEQ ID NO: 876237

SEQ ID NO: 876246 - protein, 241 aa, Homo sapiens
MTTLTRQDLNFGQGREAGPAGPGAGASGPAGFLERATGLCPPAVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876247 - protein, 224 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSIRWAAPAPRPLAGISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 876248 - protein, 120 aa, Homo sapiens
PKYAGNKEHNECNGTSHFNSNIECKWPKCSTKRYRTAEWIRTNQSTICYLQETHLTHKDSHKLKVKGWKKAFHANGHQKQAGAAILISDKTNFKATVVKRDKEGHYITVNGWSNRKTSQP

SEQ ID NO: 876249 - protein, 188 aa, Homo sapiens
MMTSPKALLFFIWLASETQGSAQRRLAPASRDPSGRHLCCQAVQVLSFPGPLFRELCAQLPHLHCALGIARSQELSLLAVELQTVDRAFILGLLDQNCGFLGAFLEIKQLHVTFPRGSCKNQGPHWGPAHSKQILEGELQRSQGRGLQHGVQVDMPVSPSAQEEIPVEGGTAHRVDGTAVGGEGKLCW

SEQ ID NO: 876250 - protein, 118 aa, Homo sapiens
MWASSWSLSVDAERLHAGWRVDVAPAELRVDVGIIVVVEHGHLRAFTQDGGWMWHLLNRGWMWASSWLLRVDTESLHTGWWVDVAPAEQRVDVGIIVVIECGCPPDPVALLDREVLHR

SEQ ID NO: 876251 - protein, 87 aa, Homo sapiens
GTASDLEGFSAQDVKIKVPPTHATHATLTHAAHERPQNTRSCPTSTLLKSKSSPSCGTRACCLLHPSPQGPLPSPRCCRADGDPGTE

SEQ ID NO: 876252 - protein, 147 aa, Homo sapiens
FCVPKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPL

SEQ ID NO: 876253 - protein, 90 aa, Homo sapiens
LLCLLAEAEHNQEMSGRSLLRISSKLQLWLSKFLCDCMKVICWGADEQHGQMPWSPAHPGLSFSPLKNSLCCSHENRLHLREHHLSRFVG

SEQ ID NO: 876254 - protein, 1045 aa, Homo sapiens
MGSQPPLGSPLSREEGEAPPPAPASEGRRRSRRVRLRGSCRHRPSFLGCRELAASAPARPAPASSEIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 876255 - protein, 978 aa, Homo sapiens [sequence omitted]

SEQ ID NO: 876256 - protein, 1045 aa, Homo sapiens; identical to SEQ ID NO: 876254

SEQ ID NO: 876257 - protein, 669 aa, Homo sapiens
MGSQPPLGSPLSREEGEAPPPAPASEGRRRSRRVRLRGSCRHRPSFLGCRELAASAPARPAPASSEIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGVSVLPVEGVQPGSWHLEQRIGQTHIQARKE

SEQ ID NO: 876258 - protein, 107 aa, Homo sapiens
MGSQPPLGSPLSREEGEAPPPAPASEGRRRSRRVRLRGSCRHRPSFLGCRELAASAPARPAPASSEKRCSIFRLRKTTRAQWRLPHFFSSSCWSSRRKAGSVAFWMP

SEQ ID NO: 876259 - protein, 1045 aa, Homo sapiens; identical to SEQ ID NO: 876254

SEQ ID NO: 876260 - protein, 581 aa, Homo sapiens
PTFRVEVGMIRRIIESIMGRKERKVNDPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 876261 - protein, 46 aa, Homo sapiens
MAVTTFRRNIPIKTQQIWKTEHMKQKYLKIFRNLENLNYILRHRMS

SEQ ID NO: 876262 - protein, 36 aa, Homo sapiens
DASKRTLQMSLLTGGLCDCRRKGPSRTHHLPPEAPP

SEQ ID NO: 876263 - protein, 191 aa, Homo sapiens
TGLSPGAESIAGDRRGREEVASMAPASSSHAAPSPGHGASLGVRDQGVQSELLYLTKERPLLFTRATALLPQDLFILPVLGLSICKLEVLRAGKGGCEEGFGQLLLLSEVASSSRHGGLSTTGLLGYLPLICSLVRALVNRQARGAGTRRGLQRVQYQIFQTQHLCPGVSKLSSALGFIHTVKLPVYANDM

SEQ ID NO: 876264 - protein, 251 aa, Homo sapiens
SLGPPWESGRRAVGSQNRDPGPSPLLPHHVPCQDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKAASPPSESHGRRKQKRICGSTAALQPRPSPISIFHRLPQIFDEAPDMMNAGHP

SEQ ID NO: 876265 - protein, 249 aa, Homo sapiens
KEFGTGGGDRGAVVAAAAAAGASMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRTFERDCREAEKAAQTAERLDQDINATKADVEKAKAASPPSESHGRRKQKRICGSTAALQPRPSPISIFHRLPQIFDKAPDMMNAGHP

SEQ ID NO: 876266 - protein, 140 aa, Homo sapiens
KEFGTGGGDRGAVVAAAAAAGASMDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQELCLLPSFHH

SEQ ID NO: 876267 - protein, 101 aa, Homo sapiens
SHVSSHPYKLGPQWRGVAGPQRPEPHKLTHPPPGLPLPVPPADGLLGDPGARSPQYCPRSERGRWMHQQHQGIGLTPKTLPTPAPNPNQKIAPKKGMSSQK

SEQ ID NO: 876268 - protein, 101 aa, Homo sapiens
SRQGGTRALASPADPAIVSLRASERTEAYARAGRPAGGNREWGPSPCSVWTQRESIWVRLVQGEAVRSVHKGQGSRGHKSLGLRPYGASGKPPIRSLGALI

SEQ ID NO: 876269 - protein, 59 aa, Homo sapiens
VSYVRPAEPAFLARFKERVGYREGPTVETKRIQPQPPDEDGDHSDKEDEQPQVVVLKKG

SEQ ID NO: 876270 - protein, 556 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 876271 - protein, 133 aa, Homo sapiens
VSPSPPHRSAATSPLLQWPRTRYSDHPNLATVPPKPARGGHDLFRRSARQGPDALQALLRRVRPGLPLPRRGALWETTWGSGWGCRLRHPQGQCLPCIQALALCSELAWPGQGVETALCPPAPRRASRGGPPQ

SEQ ID NO: 876272 - protein, 202 aa, Homo sapiens
VVPSSVKTHRATSHILYPRWSPGSASQLHHLCLSAGRQLCWGLLKQPLSVLPFFSHCSHVKISTRFEDTKFLPRIIGEWNIWLEIDEFLFLKNDNKGWTRWLMPVIPGLWEAEAGGSLEARSSRPAWPTWRKLVCAKKTKISQAWSCAPVIPVTQEAEAGNCLNPVGGGCIEPRSCHCTPAWVTEPESVSNYTSKTTRICQK

SEQ ID NO: 876273 - protein, 133 aa, Homo sapiens; identical to SEQ ID NO: 876271

SEQ ID NO: 876274 - protein, 556 aa, Homo sapiens; identical to SEQ ID NO: 876270

SEQ ID NO: 876275 - protein, 556 aa, Homo sapiens; identical to SEQ ID NO: 876270

SEQ ID NO: 876276 - protein, 538 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEA

SEQ ID NO: 876277 - protein, 562 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRSISEIPKKILSANGSNHFPLPGSQVLTMFTNRGWQKCSMTLRTWRSAGAVRASTWTWSSTRVALTEGRK

SEQ ID NO: 876278 - protein, 635 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 876279 - protein, 560 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEGVSGRASFCGKRQQQQWPGRRHR

SEQ ID NO: 876280 - protein, 547 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMRKMKLGLVN

SEQ ID NO: 876281 - protein, 556 aa, Homo sapiens; identical to SEQ ID NO: 876270

SEQ ID NO: 876282 - protein, 590 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPG

SEQ ID NO: 876283 - protein, 621 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQVRSLPRIVS

SEQ ID NO: 876284 - protein, 621 aa, Homo sapiens; identical to SEQ ID NO: 876283

SEQ ID NO: 876285 - protein, 635 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGGGDFEYPAVLYGKRGKYKEAEPLCKRALEIREKVLGKDHPDVAKQLNNLALLCQNLGKYEEVEYYYQRALEIYQTKLGPDDPNVARGVC

SEQ ID NO: 876286 - protein, 626 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 876287 - protein, 565 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRVAEVLNDPENMEKRRSRESLNVDVVKYESGPDGGEEVSMSVEWNGGVSGRASFCGKRQQQQWPGRRHR

SEQ ID NO: 876288 - protein, 459 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFLEWLYQLDYQLLDRERP

SEQ ID NO: 876289 - protein, 202 aa, Homo sapiens; identical to SEQ ID NO: 876272

SEQ ID NO: 876290 - protein, 120 aa, Homo sapiens
GGARRGAGGSNTETPFSAAGAAQAAERDWLGRLGCWCEEPRGCARRPRGQRVGGRGCCGAVAPAPLAGDCCAVPHTAEAGSAHSRCSALAPGGAPGADSARERGPQEQGECMTTCPQWCT

SEQ ID NO: 876291 - protein, 569 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGGVSGRASFCGKRQQQQWPGRRHR

SEQ ID NO: 876292 - protein, 124 aa, Homo sapiens
LGVGVPQRAVSRTELSNTVRFWRPSPDLLSSLAVTPTWPRSRMGLPSVARSWPGTARAAGRAPGREPQRSLISPASVCIGHDTNNHTAGVTLGLGLGLSWCPGAAWSLPGDLGHELGPRLPSHV

SEQ ID NO: 876293 - protein, 547 aa, Homo sapiens; identical to SEQ ID NO: 876280

SEQ ID NO: 876294 - protein, 547 aa, Homo sapiens; identical to SEQ ID NO: 876280

SEQ ID NO: 876295 - protein, 548 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRVAEVLNDPENMEKRRSRESLNVDVVKYESGPDGGEEVSMSVEWNGMRKMKLGLVN

SEQ ID NO: 876296 - protein, 562 aa, Homo sapiens; identical to SEQ ID NO: 876277

SEQ ID NO: 876297 - protein, 539 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRVAEVLNDPENMEKRRSRESLNVDVVKYESGPDGGEEMRKMKLGLVN

SEQ ID NO: 876298 - protein, 537 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLIEEAAMRLVNGLDNVHKQRVAEVLNDPENMEKRRSRESLNVDVVKYESGPDGGEEVSMSVEWNGMRKMKLGLVN

SEQ ID NO: 876299 - protein, 547 aa, Homo sapiens; identical to SEQ ID NO: 876280

SEQ ID NO: 876300 - protein, 590 aa, Homo sapiens; identical to SEQ ID NO: 876282

SEQ ID NO: 876301 - protein, 621 aa, Homo sapiens; identical to SEQ ID NO: 876283

SEQ ID NO: 876302 - protein, 528 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLIEEAAMRLVNGLDNVHKQRVAEVLNDPENMEKRRSRESLNVDVVKYESGPDGGEEMRKMKLGLVN

SEQ ID NO: 876303 - protein, 538 aa, Homo sapiens; identical to SEQ ID NO: 876276

SEQ ID NO: 876304 - protein, 475 aa, Homo sapiens
MSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSNPDNTQLLLVTLKKPWAGF

SEQ ID NO: 876305 - protein, 196 aa, Homo sapiens
MSTMVYIKEDKLEKLTQDEIISKTKQVIQGLEALKNEHNSILQSLLETLKCLKKDDESNLVEEKSNMIRKSLEMLELGLSEAQQNSVASLEYYLRIFVCHVKKRKWDDDYVRYWFTCTTEVDGTQRPQCVLCNSVFSNADLRPSKLSDHFNRQHGGVAGHDLNSLKHMPAPSDQSETLKAFGVASHEDTLLQASYQ

SEQ ID NO: 876306 - protein, 110 aa, Homo sapiens
KAKKEAPPMEKQEVVKTHLRDMIILPEMVGSMVGVYNGKTFNQVEIKPEMIGHYLGEFSITSPSTPPRKLREPAPPWPAEKGAPTVQRRAEGLLKCRQSGSPGRGGAESE

SEQ ID NO: 876307 - protein, 553 aa, Homo sapiens
EVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKRTFQEQVSDTENNLNQGPSLMETIFRILYHCSFSPQTFANVFVSYMEEEQLWDFLYNIPGMRHLLFVKEMFYRYLYVPLKMFRSCIDTGFAESVVGESLPYIFSV

SEQ ID NO: 876308 - protein, 641 aa, Homo sapiens
EVVMEKPRANETNIPSEQSLPGKEATLLDFGWRSAFKEVSLPMAHCVVTAIEGFSTKILQQEQNERSSAVSYAMNLVNVQQVWQDSHMFPEEEQPKKIGKFCSDIMEKLDTMLPLALACRDDSFQEIRANLVEACCKVATAVLQRLQERAKEVPSKAPLKNLHTYLSTAVYVFQHFKRYDNLMKEMTKKPIFLVLVQRYQEFINTLQFQVTNYCVRVCATSILQDAESHHWDDYKAFYEGERCSFSIQMWHYFCWSLHYDLWTILPPKLAQEILVEVLEKSLSLLASRYARAHPSRKRTPQLRLDVTTILICTENMLWSVCTSVQKLLNPHQHTDDKIFKIHTHCNNLFTTLVILTSPLTELYKTFQHGLDESASDSLKSFFKQPLYWVSCISHFYPSLLRTPSAGGLKAEGQLKLLLSQPRCNWNLLLETLLHHDGLLLRILLKSSKRTFQEQVSDTENNLNQGPSLMETIFRILYHCSFSPQTFANVFVSYMEEEQLWDFLYNIPVSTCVEYELEVIRCLRLALTDAIKDAVQQIVSVMSSRRNCETNLNKHVVPDCLLESMPKEWNYGPKETNRKESCKSFTRLTAQAVSIVISKLPTVIACLPPPVKYFFFLSERKMSKKFVELKKAGLLVWNLIVI

SEQ ID NO: 876309 - protein, 336 aa, Homo sapiens
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 876310 - protein, 235 aa, Homo sapiens [sequence omitted]

SEQ ID NO: 876311 - protein, 421 aa, Homo sapiens
HSGRGARGGGAGRRGLCSWGLGLGRLDLTLGRLAQLSGRDCVQPRRACFPDLPKFGCPSCPFAAAGLPGPRVRRLRREELISLFSMTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 876312 - protein, 336 aa, Homo sapiens; identical to SEQ ID NO: 876309

SEQ ID NO: 876313 - protein, 129 aa, Homo sapiens
HSGRGARGGGAGRRGLCSWGLGLGRLDLTLGRLAQLSGRDCVQPRRACFPDLPKFGCPSCPFAAAGLPGPRVRRLRREVGGTRQRRDRGLAASAFSFPRGLRREALKRPAAGDRPSPSAGLRSAFAVRR

SEQ ID NO: 876314 - protein, 336 aa, Homo sapiens; identical to SEQ ID NO: 876309

SEQ ID NO: 876315 - protein, 336 aa, Homo sapiens; identical to SEQ ID NO: 876309

SEQ ID NO: 876316 - protein, 298 aa, Homo sapiens
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGKNIPSFLQLIGMLKK

SEQ ID NO: 876317 - protein, 336 aa, Homo sapiens; identical to SEQ ID NO: 876309

SEQ ID NO: 876318 - protein, 336 aa, Homo sapiens; identical to SEQ ID NO: 876309

SEQ ID NO: 876319 - protein, 133 aa, Homo sapiens
TSSCRFGTIPDKESGGGSHGNAASSCSRFHYSYAGVHSESTHFSLVLLLDWAMAFILCPLTCPGECEGSTGKLECCLCLPSQWAVLTAAPHPYRWSQEAGRVGEGKIGKTGRPRPRQNSLSSLHFWSPVVMCL

SEQ ID NO: 876320 - protein, 132 aa, Homo sapiens
MHPWNQQVPDKESGGGSHGNAASSCSRFHYSYAGVHSESTHFSLVLLLDWAMAFILCPLTCPGECEGSTGKLECCLCLPSQWAVLTAAPHPYRWSQEAGRVGEGKIGKTGRPRPRQNSLSSLHFWSPVVMCL

SEQ ID NO: 876321 - protein, 132 aa, Homo sapiens; identical to SEQ ID NO: 876320

SEQ ID NO: 876322 - protein, 132 aa, Homo sapiens; identical to SEQ ID NO: 876320

SEQ ID NO: 876323 - protein, 132 aa, Homo sapiens; identical to SEQ ID NO: 876320

SEQ ID NO: 876324 - protein, 132 aa, Homo sapiens; identical to SEQ ID NO: 876320

SEQ ID NO: 876325 - protein, 987 aa, Homo sapiens
IPVSPALGQLMLFVDGMLGVVAHSDTIQWLYTLCASLSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 876326 - protein, 1170 aa, Homo sapiens
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEAWLHPQKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 876327 - protein, 1139 aa, Homo sapiens [sequence omitted]

SEQ ID NO: 876328 - protein, 1164 aa, Homo sapiens
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 876329 - protein, 1164 aa, Homo sapiens; identical to SEQ ID NO: 876328

SEQ ID NO: 876330 - protein, 1164 aa, Homo sapiens; identical to SEQ ID NO: 876328

SEQ ID NO: 876331 - protein, 1253 aa, Homo sapiens
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLDKWLSTQPYTLCLLLLCGPQLPVLQSELEGSESEASVSLEGTSVPGPGARVILPRFSLGPAPAALPLPQQQLAQVWPKPHFICTDLSPQSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 876332 - protein, 283 aa, Homo sapiens
MCTPLLSQVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 876333 - protein, 1164 aa, Homo sapiens; identical to SEQ ID NO: 876328

SEQ ID NO: 876334 - protein, 127 aa, Homo sapiens
PQPCLLIPALQTLAALPDQDSFYDVTDALEQQGMEALVQRHLGTAGTDVDLRTQLVLYEVGRALRSEADWKEGREKRSPQRPTPPAYTLTTFLHPGPPLLERPEIGGWRHRRSPRRWWAAGTTKAFF

SEQ ID NO: 876335 - protein, 465 aa, Homo sapiens
AQTSFSTSSDQCSEPETKWSSSSFEAGDGDSSHEDRAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLELEEAVLKFRQKPSSIRCPGLPGLRATHPSLTKAPGCSQAGSWEYTHCQQACVSHRGARGLHLHTPELLSPDSGTAPNSGLGSWVAHHGSRACAPHCCVPIAFCSFKSVEKKMTDMLKEEEERLQLAHSNMTKGQELLLTIQMGIDNLYVRLMGINLPATQVPGVRLSCHTPGPWAGPEGRGDPPPGLQREVVLSNTLDLNSKLAYCEGKLTYLADRVQMVSRTEEGDTKVRDTLESSTLMEKYNTRISFENREEDMIGLLRTLGRPGSRRGARDTQDRGRFCVRRQPGPGTARQNRVRMRRPRAPRPRGPRGAP

SEQ ID NO: 876336 - protein, 878 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876337 - protein, 878 aa, Homo sapiens; identical to SEQ ID NO: 876336

SEQ ID NO: 876338 - protein, 763 aa, Homo sapiens
MENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876339 - protein, 914 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEVLATPLPGRPGLGGMRSWDQGCGFLDSMAPHPCAPQEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876340 - protein, 856 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVRSVYRGWAGAAWLWGVRCPGTCLPAPPLR

SEQ ID NO: 876341 - protein, 520 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876342 - protein, 744 aa, Homo sapiens
RGSRITRVWWSYVEITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876343 - protein, 497 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETK

SEQ ID NO: 876344 - protein, 257 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQVSTHHVGWSGCWSLTSFQVSPV

SEQ ID NO: 876345 - protein, 478 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPEGDPKVTTEMWIYCESVSQEYCWMREPNEIGKGGVHFLGHTGERLTSPLAGPEVWHLLRTGSLQLCGEAASLQDVRAGQQKERFPTQHQRLSLGCRCWTRCSAVVCPGGITERGGRSRQGRPRWACSFLLVCRVPGKTEAGGGARYICRETRFRKALEE

SEQ ID NO: 876346 - protein, 314 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQKDVRLAQERGCAVVLVSEEVRMPAGWDCCWGRLGWKEGGSQTCPVPALLGRPLLPAEPSPHHWVDYSLESSPLLSCSIP

SEQ ID NO: 876347 - protein, 257 aa, Homo sapiens; identical to SEQ ID NO: 876344

SEQ ID NO: 876348 - protein, 136 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESMALGPVPSLLP

SEQ ID NO: 876349 - protein, 125 aa, Homo sapiens
PEEHEAKGGVLHRGAPGKGEPAQPAEEADRQDPHEGDQREVPPGKPQARAWLAAHPHDSWVDTGSGPPLRAHSLPRMSHPFPAPTSHQGQMDLDFPSNLMSTETLKCKRSAPHLPPARVPRRGWH

SEQ ID NO: 876350 - protein, 116 aa, Homo sapiens
KGPKLSSTCRRSSRADPRAQDFATRCQPGAGGVPVTAWGGICLCTIAFAAAPWLPCALLSWKRPGIGGPQAGPCRCWAFRPSVSLLCKKGGDSWLQPGSVDTLALSGQSRQCFSGM

SEQ ID NO: 876351 - protein, 878 aa, Homo sapiens; identical to SEQ ID NO: 876336

SEQ ID NO: 876352 - protein, 878 aa, Homo sapiens; identical to SEQ ID NO: 876336

SEQ ID NO: 876353 - protein, 1423 aa, Homo sapiens
MGKEGRELRGHGHKWFRKRVWPLAGDAVPKSSKVSMANRPLALLPLGALLRQLPNPVPTRMSPEEHEQREASFIEERRARENRLNQQKKLIDKIHTKETSEKYRRGQMDLDFPSNLMSTETLKLRRKETSTAEMEYQSGVTAVVEKVKSAVRCSHVWDITSRFLAQRNTEENLELQMEDCEEWRVQLKALVKQLELEEAVLKFRQKPSSISFKSVEKKMTDMLKEEEERLQLAHSNMTKGQELLLTIQMGIDNLYVRLMGINLPATQREVVLSNTLDLNSKLAYCEGKLTYLADRVQMVSRTEEGDTKVRDTLESSTLMEKYNTRISFENREEDMIDTFQFPDMDHSYVPSRAEIKRQAQRLIEGKLKAAKKKKKYAPPPRSLLCYTNKHFSRTAADAGATGVSERSTGHAGSGEVLRKEAARARNCAPEPRAHAPTARAAPPRPSRRPVAAHPSLSRRAGAKMAALTPGERSRRSRGGRSGAAAAEVPESPLGAALRRRDPGLWPRRLRPPGGPGPPGHGASRTPSPPPLSSPAAPGLGRPSGKMFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876354 - protein, 878 aa, Homo sapiens; identical to SEQ ID NO: 876336

SEQ ID NO: 876355 - protein, 878 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVRSVYRGWAGAAWLWGVRCPGTCLPSALIWGRSMPMVPLPAGSPEHGCADSP

SEQ ID NO: 876356 - protein, 880 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEHPTPPLSHNKNQGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876357 - protein, 832 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAQGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 876358 - protein, 658 aa, Homo sapiens [sequence omitted]

SEQ ID NO: 876359 - protein, 327 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPRVERDPLD

SEQ ID NO: 876360 - protein, 257 aa, Homo sapiens; identical to SEQ ID NO: 876344

SEQ ID NO: 876361 - protein, 198 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDSPLHWDPVV

SEQ ID NO: 876362 - protein, 142 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESETAWMCRRVQNCTGVSP

SEQ ID NO: 876363 - protein, 213 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREGLPDPSRVSSEVQQMWALTEMIRASHTSARIGRFDVDGCYDLNLLSYT

SEQ ID NO: 876364 - protein, 192 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREGILRGAADVGTDRDDPGQSHLRKDRPL

SEQ ID NO: 876365 - protein, 171 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREVSPHPR

SEQ ID NO: 876366 - protein, 175 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQSPSVTFPKWLSHPVPCEQPALLREGLPDPSRVSSEVQQMWALTEMIRASHTSARIGRFDVDGCYDLNLLSYT

SEQ ID NO: 876367 - protein, 213 aa, Homo sapiens; identical to SEQ ID NO: 876363

SEQ ID NO: 876368 - protein, 213 aa, Homo sapiens; identical to SEQ ID NO: 876363

SEQ ID NO: 876369 - protein, 204 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREGLPDPSRVSSEVQQMWALTEMIRASHTSARIGRFDVDVA

SEQ ID NO: 876370 - protein, 213 aa, Homo sapiens; identical to SEQ ID NO: 876363

SEQ ID NO: 876371 - protein, 169 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLRELEGP

SEQ ID NO: 876372 - protein, 213 aa, Homo sapiens; identical to SEQ ID NO: 876363

SEQ ID NO: 876373 - protein, 171 aa, Homo sapiens; identical to SEQ ID NO: 876365

SEQ ID NO: 876374 - protein, 174 aa, Homo sapiens
GRLLWSKEAQQGAPGGGIGGCKGPGVRRAVRGGWGKGSAQALGAWVAGKDLLWCPEGHRRDPVEAKAEAAQGFLFPSRASVAAVTLTFRFWGTQGQRLQHCARLRRGPSSLPHTFRESLLFQNPTDDLLLSELLLLLKGPAWSRFSDECKRSPASTLPQTALPGCLLHARPAPG

SEQ ID NO: 876375 - protein, 145 aa, Homo sapiens
VQKCRHSRQAKHLLLPSPPWQNPQSGSTESPRLQLCAKQPRGTEHGLASCPQVWRRDAHRGLPGGAAMTPGDTWASFNPRAGHSKSQGEGQESSGASRQDRHPVSRWVERQREAWGAPRSSSAGGVKVAATTEREPEFKIKTGKA

SEQ ID NO: 876376 - protein, 198 aa, Homo sapiens
MAQKPKVDPHVGRLGYLQALVTEFQETQSQDAKEQVLANLANFAYDPSNYEYLRQLQVLDLFLDSLSEENETLVEFAIGGLCNLCPDRANKEHILHAGGVPLIINCLSSPNEETVLSAITTLMHLSPPGRSFLPELTATPVVQCMLRFSLSASARLRNLAQIFLEDFCSPRQVAEARSRQAHSALGIPLPRSVAPRQR

SEQ ID NO: 876377 - protein, 159 aa, Homo sapiens
MLVRGWVDSNYEYLRQLQVLDLFLDSLSEENETLVEFAIGGLCNLCPDRANKEHILHAGGVPLIINCLSSPNEETVLSAITTLMHLSPPGRSFLPELTATPVVQCMLRFSLSASARLRNLAQIFLEDFCSPRQVAEARSRQAHSALGIPLPRSVAPRQR

SEQ ID NO: 876378 - protein, 140 aa, Homo sapiens
QGRWEEARGYSIQTLPCSPTGGLCNLCPDRANKEHILHAGGVPLIINCLSSPNEETVLSAITTLMHLSPPGRSFLPELTATPVVQCMLRFSLSASARLRNLAQIFLEDFCSPRQVAEARSRQAHSALGIPLPRSVAPRQR

SEQ ID NO: 876379 - protein, 198 aa, Homo sapiens; identical to SEQ ID NO: 876376

SEQ ID NO: 876380 - protein, 151 aa, Homo sapiens
MAQKPKVDPHVGRLGYLQALVTEFQETQSQDAKEQVLANLANFAYDPSNYEYLRQLQVLDLFLDSLSEENETLVEFAIAAAVLNGDGGPCRSMWLNLHQGAIELLQIKLLPLEKNWRKSQSSPHQKCLPSGVFPAGVSSGSGSNFPRTGAP

SEQ ID NO: 876381 - protein, 949 aa, Homo sapiens
DADKLKKKTAEDRTQAFHLRQNLSALDKMHEEQELFTEKMRGELRACRQRRDLIDKQQEAVAAEIATEEEAGNMAAVGRLQAVSRRLFAELENERDLQSRTEAVLKESENTMWHIEIQEGRLEAFRTADREEVEATGRRLQVRAAEQLCREQEALGKVERNRLLRIRKSLNTQKELGLRHQKLLEDARKNHKVAVRFLKASLGRIREQEKKEEMECHEYMRRRMDAVVALKGSISANRDTLRKFQAWDRAKAELAEQRVQAEKKAILAQGRDAFRHLVHQRRRQELEAQKRAFEEEQKLRKQEIISRILKEEAEEEKRKKQHPPTSARHRLTLRDKTWNYISDFCKKTTVPTNTYTLDYEAAAGPGPSRLLEVVSSELIQGDPGASSEEETLAEPEISGLWNEDYKPYQVPKEDVDRKPVGGTKMDKDILERTVERLRSRVVHKQVVWGREFQGRPFNSKPELLHFQDFDIGKVYKKKITLVNTTYTINYCKLVGVEEHLRDFIHVDFDPPGPLSAGMSCEVLVTFKPMINKDLEGNISFLAQTGEFSVPLKCSTKKCSLSLDKELIDFGSYVVGETTSRTITLTNVGGLGTTFKFLPASEPCEMDDSQSALKLSSLLTYEDKSLYDKAATSFSEQQLEGTESSQADMQSRKELEKLDKEQEEEQPAGEPGCQAKPGWAGGEGLRAAFQGAEGPRGGLESREFSQAFDVKGRLSKKIFLCATEVLFLEWTKMYIHVDANRRLEGTSSIGPAGPARAEPHRAGKRLCGAPWRGRAAGGFCLALQLWLLLDAHQRGEVPRNGRALPSPCLLPCSPPPSGIACVSSLLLLIVFPHTHRDPETSVLLLSVFSVVRVPHALQLSAELGRFSTACVSLTSGVSRTSGVSRTSCPHHCVAFPFLREPRVLDPSFCQCALGSVRGTHCCEGRSALPLGLCVSSHRAPGWGSCLHHRA

SEQ ID NO: 876382 - protein, 468 aa, Homo sapiens
TVLWVVRRASALRSTNPRVLWVTPCSFDPPGPLSAGMSCEVLVTFKPMINKDLEGNISFLAQTGEFSVPLKCSTKKCSLSLDKELIDFGSYVVGETTSRTITLTNVGGLGTTFKFLPASEPCEMDDSQSALKLSSLLTYEDKSLYDKAATSFSEQQLEGTESSQADMQSRKELEKLDKEQEEEQPAGEPGCQAKPGWAGGEGLRAAFQGAEGPRGGLESREFSQAFDVKGRLSKKIFLCATEVLFLEWTKMYIHVDANRRLEGTSSIGPAGPARAEPHRAGKRLCGAPWRGRAAGGFCLALQLWLLLDAHQRGEVPRNGRALPSPCLLPCSPPPSGIACVSSLLLLIVFPHTHRDPETSVLLLSVFSVVRVPHALQLSAELGRFSTACVSLTSGVSRTSGVSRTSCPHHCVAFPFLREPRVLDPSFCQCALGSVRGTHCCEGRSALPLGLCVSSHRAPGWGSCLHHRA

SEQ ID NO: 876383 - protein, 110 aa, Homo sapiens
MHGLFWPFPTETRASIKNGTLSSVSLPAFKRLRCFSLRQGLTSVSRAFLRYNFPCLLLSKLELFISSLGNVDPLSHTYGNIIKHAVRYVVFIFINSLINTDAARFFFSHY

SEQ ID NO: 876384 - protein, 102 aa, Homo sapiens
MHGLFWPFPTETRASIKNGTLSSVSLPAFKRLRCFSLRQGLTSVSRAFLRYNFPCLLLSKLELFISSLGNVDPLSHTYGNIIKHAVRYVVFIFINSLINKRV

SEQ ID NO: 876385 - protein, 111 aa, Homo sapiens
MGMWPQAVSISGCWLCSKPSVLVHIAPCPGLLRVGHLSLLLTVWLSSPLQAWGWCDAAICQTRAPESQRYNQRQKNKNHEQSRCLYYFPRTIALFLQWAWGRSNSHRSSST

SEQ ID NO: 876386 - protein, 109 aa, Homo sapiens
PPAKPPSGPRRPTRPRRHSNAEGFDSQGALRLLSQEGREDLTEAGEGRTPARLPQTHTLGSLSFPICTTTRLTQRSGFTVAITRPTLCLTSPTFQHTPPSRISPASCPA

SEQ ID NO: 876387 - protein, 275 aa, Homo sapiens
GGAAPSTPAAAGFRGGRRADPRRRLRDPTHPTRTHDLQNEDTDHSSTNTDRDSYTDGQRELQQGLWEVTRRDRKDVGSQKGTSDNMGGTTRDDGTARDSGHDRGDTPGTRSKEQRRTPIPTRIPEDGKERKTEAHTREHKATVRKGHRQGAQGIGNGMLATFYERQVDHNHEAHNMNLDTWRGGTHEETAKRPGQRKPKGRHSCRPIEEDTRVSNREQCGPPGECTRDQPEGTNDNRAKSTRQRTHRSEEHGTTWRRNRGKQWENRVRGKDADTP

SEQ ID NO: 876388 - protein, 387 aa, Homo sapiens [sequence omitted]

SEQ ID NO: 876389 - protein, 317 aa, Homo sapiens
MAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGCGGAWGAAGPAGWLGLGGPARPPLQLPLAGCVSRRRQAEPDQSDGEEDFYYTELDVGVDTLTDGLSSLTPVSPTASMPPAFPRLELPELLEPPALPSPLRPPAPPLPPPPVLSTVANPQSCHSDRVYQGCLTPARLEPQPTEVGACPPALSSRIGVTLRKPRGDAKKCRKVYGMERRDLWCTACRWKKACQRFLD

SEQ ID NO: 876390 - protein, 269 aa, Homo sapiens
GWEWGAWCARVPRPARGPTRGGAQSSGWVTRTPPPSPPEPPQEKPGWTRSWLPLPLQACPPALSFWGPQLQPSAQSPAQVMFQCLWKSCGKVLSTASAMQRHIRLVHLGRQAEPDQSDGEEDFYYTELDVGVDTLTDGLSSLTPVSPTASMPPAFPRLELPELLEPPALPSPLRPPAPPLPPPPVLSTVANPQSCHSDRVYQGCLTPARLEPQPTEVGACPPALSSRIGVTLRKPRGDAKKCRKVYGMERRDLWCTACRWKKACQRFLD

SEQ ID NO: 876391 - protein, 245 aa, Homo sapiens
MAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGRQAEPDQSDGEEDFYYTELDVGVDTLTDGLSSLTPVSPTASMPPAFPRLELPELLEPPALPSPLRPPAPPLPPPPVLSTVANPQSCHSDRVYQVGEATGGSWGGSQGSLEGSEALAVSPCRAA

SEQ ID NO: 876392 - protein, 206 aa, Homo sapiens
MAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGRQAEPDQSDGLPDARPPGAAAHGGRSLPTRLVLQDRSHPEEAPRRREEVPEGVWHGAPGPLVHSLPLEESLPAVPGLSPARSRT

SEQ ID NO: 876393 - protein, 206 aa, Homo sapiens; identical to SEQ ID NO: 876392

SEQ ID NO: 876394 - protein, 253 aa, Homo sapiens
GGAAPSTPAAAGFRGGRRADPRRRLRDPPPPATASAESAPSPSAGLFRGRRLRGLGVRAAAGVGAAGLGPGGPPDVDGGGGGAPDSVGAHPRPSAEVSGRPGASGLGVRRGGGWGAETPAPTEARSGPQVCNYQPPPSSSALEELSRNIDDWESLHLPPPQFLGARAQNPERVAVRLCAEEAARSAWGDCPGIPGAPDRHLPTPARPDTSVWLPGQGRALAWLAGAWGAARASSPVSPWLLPAAGHSHLPGLA

SEQ ID NO: 876395 - protein, 387 aa, Homo sapiens [sequence omitted]

SEQ ID NO: 876396 - protein, 282 aa, Homo sapiens [sequence omitted]

SEQ ID NO: 876397 - protein, 282 aa, Homo sapiens [sequence omitted]

SEQ ID NO: 876398 - protein, 258 aa, Homo sapiens
MAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGRQAEPDQSDGEEDFYYTELDVGVDTLTDGLSSLTPVSPTASMPPAFPRLELPELLEPPALPSPLRPPAPPLPPPPVLSTVANPQSCHSDRVYQGCLTPARLEPQPTEVGACPPAFPPLALNSTALGPWGCFYHVCF

SEQ ID NO: 876399 - protein, 102 aa, Homo sapiens
RPHDFILRGRAIPIKQGMLLKRSGKWLKTWKKKYVTLCSNGVLTYYSSLGDYMKNIHKKEIDLRTSTIKVPGKWPSLATSACAPISSSKSNGLSKDMRHRAG

SEQ ID NO: 876400 - protein, 185 aa, Homo sapiens
TSQEDLYFSVPPTANTPTPICKQSMGWSNLFTSEKGSDPDKGRKALESHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMEALHMSANSDIGLGDSICFSPSISSTTSPKLNLPPSPHANK

SEQ ID NO: 876401 - protein, 164 aa, Homo sapiens
TSQEDLYFSVPPTANTPTPICKQSMGWSNLFTSEKGSDPDKGRKALESHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMEALHMSANSHFALRACPVFQ

SEQ ID NO: 876402 - protein, 199 aa, Homo sapiens
MPNYKLTYFNMRGRAEIIRYIFAYLDIQYEDHRIEQADWPEIKSTLPFGKIPILEVDGLTLHQSLAIARYLTKNTDLAGNTEMEQCHVDAIVDTLDDFMSCFPWAEKKQDVKEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 876403 - protein, 102 aa, Homo sapiens
FFTIIIFFICYQSRTEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 876404 - protein, 170 aa, Homo sapiens
MAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 876405 - protein, 103 aa, Homo sapiens
SWRATPAAPPPPYPNEKENLSADGLLFIHSRKMNLTRGINLRKIAELMPGASGAEVKGVCTEAGMYALRERRVHVTQEDFEMAVAKVMQKDSEKNMSIKKLWK

SEQ ID NO: 876406 - protein, 267 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876407 - protein, 267 aa, Homo sapiens; identical to SEQ ID NO: 876406

SEQ ID NO: 876408 - protein, 259 aa, Homo sapiens
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876409 - protein, 259 aa, Homo sapiens; identical to SEQ ID NO: 876408

SEQ ID NO: 876410 - protein, 244 aa, Homo sapiens
MEFVSCLPQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876411 - protein, 170 aa, Homo sapiens; identical to SEQ ID NO: 876404

SEQ ID NO: 876412 - protein, 240 aa, Homo sapiens
MELEEGKAGSGLRQYYLSKIEELQLIVNDKSQNLRRLQAQRNELNAKVRLLREELQLLQEQGSYVGEVVRAMDKKKVLVKVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876413 - protein, 170 aa, Homo sapiens; identical to SEQ ID NO: 876404

SEQ ID NO: 876414 - protein, 170 aa, Homo sapiens; identical to SEQ ID NO: 876404

SEQ ID NO: 876415 - protein, 170 aa, Homo sapiens; identical to SEQ ID NO: 876404

SEQ ID NO: 876416 - protein, 167 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKGYHGY

SEQ ID NO: 876417 - protein, 185 aa, Homo sapiens
DICGSGLGGLTDKLTQAQIFDYACNPQLFPEVQRTMLELLNQLDGFEATKNIKVIMATNRIDILDSALLRPGAQPKGVLLYGPPGTGKTLLARAVAHHTDCTFIRVSGSELVQKFIGEGGKNGEGAVCHGTGTCSIYHLHGRNRLHRLLAAGGGFWRGQACAQKLACMPCENGESMSLRRTLRWQ

SEQ ID NO: 876418 - protein, 267 aa, Homo sapiens; identical to SEQ ID NO: 876406

SEQ ID NO: 876419 - protein, 267 aa, Homo sapiens; identical to SEQ ID NO: 876406

SEQ ID NO: 876420 - protein, 267 aa, Homo sapiens; identical to SEQ ID NO: 876406

SEQ ID NO: 876421 - protein, 267 aa, Homo sapiens; identical to SEQ ID NO: 876406

SEQ ID NO: 876422 - protein, 259 aa, Homo sapiens; identical to SEQ ID NO: 876408

SEQ ID NO: 876423 - protein, 271 aa, Homo sapiens
TLQDLGPLGREQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876424 - protein, 256 aa, Homo sapiens
APRPRTTPAHNIICPRLNELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876425 - protein, 290 aa, Homo sapiens
LIHTLNNETDIRKIGGLLKTIPLTSTSLTIGSLALAGIPFLTGFYSKDHIIETQTYHTQTPEATSTWLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876426 - protein, 248 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGGKNGEGAVCHGTGTCSIYHLHGRNRLHRLLAAGGGFWRGQ

SEQ ID NO: 876427 - protein, 240 aa, Homo sapiens; identical to SEQ ID NO: 876412

SEQ ID NO: 876428 - protein, 170 aa, Homo sapiens; identical to SEQ ID NO: 876404

SEQ ID NO: 876429 - protein, 185 aa, Homo sapiens; identical to SEQ ID NO: 876417

SEQ ID NO: 876430 - protein, 128 aa, Homo sapiens
MASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYR

SEQ ID NO: 876431 - protein, 242 aa, Homo sapiens
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 876432 - protein, 229 aa, Homo sapiens
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGKFILNAFSLTWIFPKTVRCK

SEQ ID NO: 876433 - protein, 242 aa, Homo sapiens; identical to SEQ ID NO: 876431

SEQ ID NO: 876434 - protein, 248 aa, Homo sapiens
ISIFHLSDAFHIPNATPTKLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 876435 - protein, 242 aa, Homo sapiens; identical to SEQ ID NO: 876431

SEQ ID NO: 876436 - protein, 146 aa, Homo sapiens
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFIF

SEQ ID NO: 876437 - protein, 140 aa, Homo sapiens
MAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 876438 - protein, 798 aa, Homo sapiens
CPSPLRDKNKMQRANSVTVDGQGLQVTPVPGTHPLLVFVNPTKWWKTRRTTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 876439 - protein, 798 aa, Homo sapiens; identical to SEQ ID NO: 876438

SEQ ID NO: 876440 - protein, 75 aa, Homo sapiens
MVIVSRCGTGGSVTEHANEVVMKLEALQRPGGLPLSILLVLAGLTKRGASDLRHPIAEDRQSLSCATVQPSLQDV

SEQ ID NO: 876441 - protein, 86 aa, Homo sapiens
SMGAGVVSLSAESSASPSCSQSPTVDVCSYRWTEFPSFCRRSVRPCDLRSSEGGRSGIHHIQAQAMKLPVASSTLLLFSLLLVRHG

SEQ ID NO: 876442 - protein, 131 aa, Homo sapiens
LERFSQVLNVALAGVQCLQSWLTAASASCVLCNSHASASRVAGTTGMHHHAWLIFCILVETVFHYVAQGGLELLSSGNPPASAFQNVRITGVSHETWPQIQQLSDTTESLQLNAGGLSISLRQWEIIMENF

SEQ ID NO: 876443 - protein, 86 aa, Homo sapiens
KAEGAHVAQVHAEHAANLLQGAHPLRLVPAWGLQEAVAVREPQAGVGAGRGAGGTGYVMIATLLPAHTTQRGTGVMGESFKPTHQA

SEQ ID NO: 876444 - protein, 1083 aa, Homo sapiens
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 876445 - protein, 113 aa, Homo sapiens
MSQTQDYECRSHNVDLPESRIPGSNTRCSPLIQRCLRPPSTCSSRWRQDQSAPPREDVGLWTGGVGRCGCWCRVSWDLMRWLLHRVELPPHVLTEQTHLLLASPCCCEPSLQP

SEQ ID NO: 876446 - protein, 165 aa, Homo sapiens
MTPPGAPAHSLKAREGPEAEKSQIPGQLPGSGPGEGAVGSRGPQTQVLPFLFLRGRRRAGGAARRFLPSLSLCRWGSAPWASALKDTAWESVRTRCAGQGVTGARPAQPPRALEGAVSAHPSPGPTPTHPHQADQAPFLSRGGDKHVCQVLLPQATEGSPDRGQE

SEQ ID NO: 876447 - protein, 249 aa, Homo sapiens
DPERVMRVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 876448 - protein, 307 aa, Homo sapiens
LVVLAAAVQAAGNGRWGAGGAGPASAWPAPQSARAAPAAANCPERLLRPRETSGPAPGGSLPRWPRGGGVAMATASPLLPLLSPGLGWARVGGNTPGIGAFQLITEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGRLGLKSSCS

SEQ ID NO: 876449 - protein, 221 aa, Homo sapiens
MGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGRLGLKSSCSQ

SEQ ID NO: 876450 - protein, 294 aa, Homo sapiens
LVVLAAAVQAAGNGRWGAGGAGPASAWPAPQSARAAPAAANCPERLLRPRETSGPAPGGSLPRWPLPLLSPGLGWARVGGNTPGIGAFQLITEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGRLGLKSSCS

SEQ ID NO: 876451 - protein, 144 aa, Homo sapiens
QRLWLLRMEGPLMVALPSPRQICIFVGETLLFSNWAITADILMYVVIPTRRATAVALQSFTSHLLGDAGSPYLIGFISDLIRQSTKDSPLWEFLSLGYALMLCPFVVVLGGMFFLATALFFVSDRARAEQQVNQLAMPPASVKV

SEQ ID NO: 876452 - protein, 146 aa, Homo sapiens
MCQSSARARPPLMHHPDPRPSLPQGEPAGDAARICESLRWCHWDNEEPTLPPRLGGVLQRPGPAGLPQSFLCDPRLGTHPLWPRPAEWPWHQEEAVSSVTLEGCVCWSHTVGQVPSPRFGPQGPGAKEEDSPKWVSGESLACHQLM

SEQ ID NO: 876453 - protein, 198 aa, Homo sapiens
QRLWLLRMEGPLMVALPSPRQICIFVGETLLFSNWAITADILMYVVIPTRRATAVALQSFTSHLLGDAGSPYLIGFGEPAGDAARICESLRWCHWDNEEPTLPPRLGGVLQRPGPAGLPQSFLCDPRLGTHPLWPRPAEWPWHQEEAVSSVTLEGCVCWSHTVGQVPSPRFGPQGPGAKEEDSPKWVSGESLACHQLM

SEQ ID NO: 876454 - protein, 144 aa, Homo sapiens; identical to SEQ ID NO: 876451

SEQ ID NO: 876455 - protein, 273 aa, Homo sapiens
ALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFGEPAGDAARICESLRWCHWDNEEPTLPPRLGGVLQRPGPAGLPQSFLCDPRLGTHPLWPRPAEWPWHQEEAVSSVTLEGCVCWSHTVGQVPSPRFGPQGPGAKEEDSPKWVSGESLACHQLM

SEQ ID NO: 876456 - protein, 248 aa, Homo sapiens
ALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFVSSPGVGLAGEAGGLQEGSALTSTPKSSQISDLIRQSTKDSPLWEFLSLGYALMLCPFVVVLGGMFFLATALFFVSDRARAEQQVNQLAMPPASVKV

SEQ ID NO: 876457 - protein, 170 aa, Homo sapiens
NTFGLIPLNLSPPSADDNINTPAERLRGPLPPSADDNLKTPSERQLTPLPPSAPPSADDNIKTPAERLRGPLPPSADDNLKTPSERQLTPLPPSAPPSADDNIKTPAFHPQRMISRHLPSVSSLPFHPQLHPQQMIISRYLLSVCGFRYPSGILYEGTTGMQAGTVSSCR

SEQ ID NO: 876458 - protein, 428 aa, Homo sapiens
MWKHKVRAKIRKRKVTTKINHHDKINGKRKSARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPQRMIISRHLPSVSSLPFHPQQMIISIHLPSVCGGRFHPQRMIISRHLPSVSSLPFHPQLHPQQMIISRHLPSVCGGRFHPQRMIISRHLPSVSSLPFHPQLHPQQMIISRHLPSTLSG

SEQ ID NO: 876459 - protein, 320 aa, Homo sapiens
MWKHKVRAKIRKRKVTTKINHHDKINGKRKSARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADE

SEQ ID NO: 876460 - protein, 294 aa, Homo sapiens
EDPSRSQKVCGRRITFETLCLLRPTRLPQASKPSADDNLKTPPECLLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPQRMIISRHLPSVSSLPFHPQQMIISIHLPSVCGGRFHPQRMIISRHLPSVSSLPFHPQLHPQQMIISRHLPSVCGGRFHPQRMIISRHLPSVSSLPFHPQLHPQQMIISRHLPSTLSG

SEQ ID NO: 876461 - protein, 390 aa, Homo sapiens
MWKHKVRAKIRKRKVTTKINHHDKINGKRKSARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPQRMIISRHLPSVSSLPFHPQQMIISIHLPSVCGGRFHPQRMIISRHLPSVSSLPFHPQLHPQQMIISRHLPSVCGGRFHPQRMIISRHLPSVSSLPFHPQLHPQQMIISRHLPSTLSG

SEQ ID NO: 876462 - protein, 263 aa, Homo sapiens
MWKHKVRAKIRKRKVTTKINHHDKINGKRKSARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLRSGCRIRSSCRTIV

SEQ ID NO: 876463 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876464 - protein, 181 aa, Homo sapiens
SIVKLTLEDKPTQRILSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELTLGSWHCSRVRLTTVPVKIAKHTVQT

SEQ ID NO: 876465 - protein, 82 aa, Homo sapiens
IDMEIAQSVLRCSVENSLTSVDRARGQVALRTSLELWMHTDPVSQKNESVRNQGGSPGTGNEKERFFSLQGYSICTFIFQIS

SEQ ID NO: 876466 - protein, 709 aa, Homo sapiens; identical to SEQ ID NO: 876463

SEQ ID NO: 876467 - protein, 615 aa, Homo sapiens [sequence omitted]

SEQ ID NO: 876468 - protein, 642 aa, Homo sapiens
MALLFLYYVDKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876469 - protein, 615 aa, Homo sapiens [sequence omitted]

SEQ ID NO: 876470 - protein, 689 aa, Homo sapiens
MDFNLILESLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876471 - protein, 730 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRQNVRLSDTFLCSFMEFLSYSRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876472 - protein, 709 aa, Homo sapiens; identical to SEQ ID NO: 876463

SEQ ID NO: 876473 - protein, 709 aa, Homo sapiens; identical to SEQ ID NO: 876463

SEQ ID NO: 876474 - protein, 456 aa, Homo sapiens
DPLETQLIQSTSTSTEIVCDPLSDYNVWSMLKPINTTGTLKPDDRVVVAATRLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876475 - protein, 620 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDVSGGGCWKCPGAPFPWESWRFF

SEQ ID NO: 876476 - protein, 709 aa, Homo sapiens; identical to SEQ ID NO: 876463

SEQ ID NO: 876477 - protein, 236 aa, Homo sapiens
PRVRNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876478 - protein, 406 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQLEPPWACLRLGLT

SEQ ID NO: 876479 - protein, 144 aa, Homo sapiens
VVCIDLHMVGWYVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876480 - protein, 709 aa, Homo sapiens; identical to SEQ ID NO: 876463

SEQ ID NO: 876481 - protein, 106 aa, Homo sapiens
DGYGGGGSDETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876482 - protein, 106 aa, Homo sapiens
LISVHFLEHLCPRGTQPLICHWNLLGLSQIGINIKEWSSTEYSTWTESRWKDIRARIFLIASKELELITLTVGFGILIFSLIVTYCINAKADVLFIAPREPGAVSY

SEQ ID NO: 876483 - protein, 403 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQLRWCGYRARL

SEQ ID NO: 876484 - protein, 395 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQGL

SEQ ID NO: 876485 - protein, 261 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATSKVHTIMVTKEHCLHLATSEKRFTVHTHLSQL

SEQ ID NO: 876486 - protein, 129 aa, Homo sapiens
FHCPSFWLLPILGFSYFTHHPPTKSSLPFGLHSGDGPLQHYIAVSSPTNTTYVVQYALANLTGTVVNLTREQCQDPSKVPSENKDLYEYSWVQGPLHSNETDRLPRCVRSTARLARALSPPPSPPAAGQ

SEQ ID NO: 876487 - protein, 769 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQGLGDRVRDRIGLGVGQRMNTTAVVAAGKNQELSDIPLVPWTGYFSDHLLPSRLPLPIKDMVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876488 - protein, 620 aa, Homo sapiens; identical to SEQ ID NO: 876475

SEQ ID NO: 876489 - protein, 742 aa, Homo sapiens
MATAGGGSGADPGSRGLLRLLSFCVLLAGLFLDFEPDPLPLCPDVSFFPQPQPPTPQSKGTGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876490 - protein, 689 aa, Homo sapiens; identical to SEQ ID NO: 876470

SEQ ID NO: 876491 - protein, 727 aa, Homo sapiens
SPAARRVASLPSLGLFLDFEPDPLPLCPDVSFFPQPQPPTPQSKGTGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876492 - protein, 638 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLITLTVGFGILIFSLIVTYCINAKADVLFIAPREPGAVSY

SEQ ID NO: 876493 - protein, 571 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876494 - protein, 709 aa, Homo sapiens; identical to SEQ ID NO: 876463

SEQ ID NO: 876495 - protein, 709 aa, Homo sapiens; identical to SEQ ID NO: 876463

SEQ ID NO: 876496 - protein, 709 aa, Homo sapiens; identical to SEQ ID NO: 876463

SEQ ID NO: 876497 - protein, 196 aa, Homo sapiens
FHCPSFWLLPILGFSYFTHHPPTKSSLPFGLHSGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876498 - protein, 132 aa, Homo sapiens
TIELVPSSIDITVCCGASSVQLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876499 - protein, 107 aa, Homo sapiens
SSSATLNLQDETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 876500 - protein, 622 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSQVQGRGPVDAAANLVVVVD

SEQ ID NO: 876501 - protein, 402 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELTLGSWHCSRVRLTTVPVKIAKHTVQT

SEQ ID NO: 876502 - protein, 89 aa, Homo sapiens
QLKDSSAVTWFLSTWCPSNQSPYSPSFPSGVYSNSYGPEFAHCREIQWNSLGNGLAYEDFSFPIFLLEDENETKVIKQVMTLPAPSNSS

SEQ ID NO: 876503 - protein, 90 aa, Homo sapiens
QKPVASRTLIQHTASAAWNKQQKPNTQWKIPEPFSLSAAQPDPRHAGNETSFLQEVKRLIPSYRTSKPLANSDVNQINQTDKRKASLGEM

SEQ ID NO: 876504 - protein, 77 aa, Homo sapiens
AAALPPPLSRPLVRSLSPLTARDWFRALLSSLALPSSFSLSLLFLFFSLSALFFVFFCSFFFFFFFFFFLQGYLYFV

SEQ ID NO: 876505 - protein, 1306 aa, Homo sapiens
QAEPSGAGTELYLFAVLFDLLVSESSLDHLMAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRRGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 876506 - protein, 1174 aa, Homo sapiens
QAEPSGAGTELYLFAVLFDLLVSESSLDHLMAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRRGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVDTQ

SEQ ID NO: 876507 - protein, 1306 aa, Homo sapiens; identical to SEQ ID NO: 876505

SEQ ID NO: 876508 - protein, 1324 aa, Homo sapiens
QAEPSGAGTELYLFAVLFDLLVSESSLDHLMAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRRGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 876509 - protein, 1303 aa, Homo sapiens
QAEPSGAGTELYLFAVLFDLLVSESSLDHLMAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRRGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 876510 - protein, 139 aa, Homo sapiens
QAEPSGAGTELYLFAVLFDLLVSESSLDHLMAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSYHSNCRLPN

SEQ ID NO: 876511 - protein, 112 aa, Homo sapiens
ALFWGPYGVPVVFPREYRGQLLAGLIPTSVAGQCPAHTKFILCVECSGVIDRVSEELRPRDLLAPIWALPFLVAMSLPSLCLTFISQVTQQYLWHLSKYWWWSHRTHTRSYL

SEQ ID NO: 876512 - protein, 142 aa, Homo sapiens
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLGHHDLESLHH

SEQ ID NO: 876513 - protein, 783 aa, Homo sapiens
WPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQGLRAYKPRENDEMALEKADVVMVTQQSSDGWLEGVKVSDGERGWFPVQQVEFISNPEVRGQNLKEAHRVKTAKLQLVEQQAKVFSEEEFRELKNKLLMARAGPRTLQERPSVDGELGLLKAQGQNPANPVPRPRLLSCLCLVRGDSTDFALDSGTFHHHTGDLG

SEQ ID NO: 876514 - protein, 757 aa, Homo sapiens
WPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYMDMGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLGHHDLESLHH

SEQ ID NO: 876515 - protein, 590 aa, Homo sapiens
WPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQ

SEQ ID NO: 876516 - protein, 563 aa, Homo sapiens
WPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPRESVTGVAGQGTRGEGDEERGGSEREREG

SEQ ID NO: 876517 - protein, 213 aa, Homo sapiens
ARDPLCSKEDSGLSLRTPGAWMTTATPGAHPFPTTPASLQPRTPASPTPRIRCVSAWPGRRGRRARGPTARPHLLFSTIQTFSYSWWGRGTLLRGRQCGLPGLALRRGGGAEYEPAEVGPAEGGSGGDAITKPVRLGAGRTAPLWTAEALHCAGRGRVPLQPLKAAAPAGRTGECGHLDEALAPKLGPPESHVPFTRQAFRGKTKRSPPNPQT

SEQ ID NO: 876518 - protein, 213 aa, Homo sapiens; identical to SEQ ID NO: 876517

SEQ ID NO: 876519 - protein, 213 aa, Homo sapiens; identical to SEQ ID NO: 876517

SEQ ID NO: 876520 - protein, 213 aa, Homo sapiens; identical to SEQ ID NO: 876517

SEQ ID NO: 876521 - protein, 191 aa, Homo sapiens
SGRRSNPFRPVLAQGLHCTWYMCMVTSTSEHPLTDRRRMVCSTVTPETDQKAPNELSVVCLPENQVQYSQVVSAQVYCHPIYWRRSAREARIDLTWKREAMRDPVSSQYSSFLFWRMPIPELDLSELEGLGLSDTATYKVKDSSVGKMIGQATAADQEKNPEGDGLLEYSTFNFWESSHVPASTPSNWTVL

SEQ ID NO: 876522 - protein, 213 aa, Homo sapiens; identical to SEQ ID NO: 876517

SEQ ID NO: 876523 - protein, 213 aa, Homo sapiens; identical to SEQ ID NO: 876517

SEQ ID NO: 876524 - protein, 213 aa, Homo sapiens; identical to SEQ ID NO: 876517

SEQ ID NO: 876525 - protein, 146 aa, Homo sapiens
AGYLGTGPRIDTERSDREHVTVVHCYCRYCSRRVCTSPALIIGTCRRLGSDRQEAMRDPVSSQYSSFLFWRMPIPELDLSELEGLGLSDTATYKVKDSSVGKMIGQATAADQEKNPEGDGLLEYSTFNFWESSHVPASTPSNWTVL

SEQ ID NO: 876526 - protein, 213 aa, Homo sapiens; identical to SEQ ID NO: 876517

SEQ ID NO: 876527 - protein, 237 aa, Homo sapiens
MRPWVAVLSLFPSRGWAGAALGPKVAPGQQPSQQHSLYGAEEEQQQQDGEVVNWGRQGTGRCSGASPCVSGAQRAEHQWVTGEKQGRLGKGAGLTEQWVAGGGAGQGLHQGGVEDEVTQQQCHLVAYALNGPEGQQPPAHVSQQQCLCRHQESDDGLERRVLQPQLEGEKSGPSRRGGRRWASGAWGLASGRASSLPPASSSPLSASSRLDSPSPGSRAPAAGVGLGSSDHKLRIPS

SEQ ID NO: 876528 - protein, 237 aa, Homo sapiens; identical to SEQ ID NO: 876527

SEQ ID NO: 876529 - protein, 152 aa, Homo sapiens
MILGMGLWIDPPRDEKAGRICQQRHGADPARCPRAVPSAQRGAVHHPGYWNPLPRIFFSPSTTAENQSARPSPVRCLHSGTSALTSCKPNLTFTGSKISISGSQWSDPTSPPSQGQATEEWSYLVFLHFPAKGKMVLPAKLSLQPGGASIKV

SEQ ID NO: 876530 - protein, 341 aa, Homo sapiens
MAHQLRPGVLLASEREQSVCTSLGRLQSRVCTWRARMCASPRAFVSHRRVCTSCALYACLPARSVVPSRGTPHPPGKGRISESLALPAGASLRSLHGARGAARLPGPAEDKRCVQSRAPGRPGRVRRERLRPQRWSPGCVGALWSLRLATGCGRESPESSQVTRRAAFWDGGRSSLEADGGAGCPGGGGSGTQALLQTTSAELGEAQAKLMEQERALRELLTHGLAEAGRDREDVSTELYRALEAVRLQNSEGSCEPCPTSWLPFGGSCYYFSVPKTTWAEAQGHCADASAHLADVGGLGEQDFLSRDTSAREYWIGRRAVQHLRKVQGYSWVDGVPLSFR

SEQ ID NO: 876531 - protein, 113 aa, Homo sapiens [sequence omitted]

SEQ ID NO: 876532 - protein, 81 aa, Homo sapiens
NFKGIIKRHLYFQVDSLSILTPLPSPQVHGSDFSLHFLLGHTSLYREQYRWLSVSPSSTSLDSTNYGSKIFEKNTKNNTTT

SEQ ID NO: 876533 - protein, 67 aa, Homo sapiens
KIPSKHERPGETPGTDAPSQPSEGTNSADTWISDFQPLKLRDNAFLLCMPLDLWDSVMAAPANEYTK

SEQ ID NO: 876534 - protein, 198 aa, Homo sapiens
GPGAGAEPRGPGHGAACPSPAVPPDPLPSAGTWPEAPPAARDPSPTLPPDPRPRTAGSLPGPAARPGENRPGGQGGGGPREAWPGSGEKGAAQPEFPTFYPGPDAAGADGTLALCLLLLLHGAMRLGGGSREKLACGRAGRAARTGRGEGGRQAEEEGRRRRRRRRRPGRTRGIPRAAGGLSRAGTRVLRYPSSHRRQ

SEQ ID NO: 876535 - protein, 198 aa, Homo sapiens; identical to SEQ ID NO: 876534

SEQ ID NO: 876536 - protein, 112 aa, Homo sapiens
WQADPPQQAINIGILHAHTQALASHLHPLPGLSFTLRLQFPSFCHIYISSQALPLSQVFISSCPLEAHRLLKVTLSTVSSSVQTRHMSQRASRPPETGPWTPPSPDHPLYPG

SEQ ID NO: 876537 - protein, 102 aa, Homo sapiens
MKTFELWDGSGQSLCGLCLPGIGPHPCHLQETWGDALDCCSLLSAHQLKTSVIPYYGGKQPVPVGLLWIQQAAFVSPNSETLQKATEWAGDCFLGREPQVLN

SEQ ID NO: 876538 - protein, 358 aa, Homo sapiens
GVLEASGRVRGRSLPAAEPGSERAQRAAGLGSMRPGGERPVEGGACNGRSELELLKLRSAECIDEAAERLGALSRAIWSQPELAYEEHHAHRVLTHFFEREPPAASWAVQPHYQLPTAFRAEWEPPEARAPSATPRPLHLGFLCEYDGCCPASATPAATTSSLRSGLAAALGVRGALEGLPRPPPPVKVVVLGTPAEEDGGGKIDLIEAGAFTNLDVVFMAHPSQENAAYLPDMAEHDVTVKYYGKASHSASYPWEGLNALDAAVLAYNNLSVFRQQMKPTWRVHGIIKNGGVKPNIIPSYSELIYYFRAPSMKELQVLTKKAEDCFRAAALASGCTVGNFKVGAPLFIYHGSFPNYK

SEQ ID NO: 876539 - protein, 469 aa, Homo sapiens
GVLEASGRVRGRSLPAAEPGSERAQRAAGLGSMRPGGERPVEGGACNGRSELELLKLRSAECIDEAAERLGALSRAIWSQPELAYEEHHAHRVLTHFFEREPPAASWAVQPHYQLPTAFRAEWEPPEARAPSATPRPLHLGFLCEYDGCCPASATPAATTSSLRSGLAAALGVRGALEGLPRPPPPVKVVVLGTPAEEDGGGKIDLIEAGAFTNLDVVFMAHPSQENAAYLPDMAEHDVTVKYYGKASHSASYPWEGLNALDAAVLAYNNLSVFRQQMKPTWRVHGIIKNGGVKPNIIPSYSELIYYFRAPSMKELQVLTKKAEDCFRAAALASGCTVEIKGGAHDYYNVLPNKSLWKAYMENGRKLGIEFISEDTMLNGPSGSTDFGNVSFVVPGIHPYFHIGSNALNHTEQYTEAAGSQEAQFYTLRTAKALAMTALDVIFKPELLEGIREDFKLKLQEEQFVNAVE

SEQ ID NO: 876540 - protein, 469 aa, Homo sapiens; identical to SEQ ID NO: 876539

SEQ ID NO: 876541 - protein, 469 aa, Homo sapiens; identical to SEQ ID NO: 876539

SEQ ID NO: 876542 - protein, 469 aa, Homo sapiens; identical to SEQ ID NO: 876539

SEQ ID NO: 876543 - protein, 469 aa, Homo sapiens; identical to SEQ ID NO: 876539

SEQ ID NO: 876544 - protein, 469 aa, Homo sapiens; identical to SEQ ID NO: 876539

SEQ ID NO: 876545 - protein, 469 aa, Homo sapiens; identical to SEQ ID NO: 876539

SEQ ID NO: 876546 - protein, 209 aa, Homo sapiens
GVLEASGRVRGRSLPAAEPGSERAQRAAGLGSMRPGGERPVEGGACNGRSELELLKLRSAECIDEAAERLGALSRAIWSQPELAYEEHHAHRVLTHFFEREPPAASWAVQPHYQLPTAFRAEWEPPEARAPSATPRPLHLGFLCEYDGCCPASATPAATTSSLRSGLAAALGVRGALEGLPRPPPPVKVVVLGTPAEEDGGKFSRDLFI

SEQ ID NO: 876547 - protein, 255 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERTRVKGLTNGGGGLDEVRNGGVEDGIEKGLQVKEEG

SEQ ID NO: 876548 - protein, 350 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKNESSLQEDEPENDAKKIEPGKLPETFYGYQTRAECRLEPGTKDCQFDRIAKRPLGPRRNIAGRGEKDRIASTQGADTKHQNHVKTKMNYPREIRKNSIALL

SEQ ID NO: 876549 - protein, 65 aa, Homo sapiens
MGQQAQAFGAPLFCHHGKAKPLHRGQGLQDALVSGSQERVCLHGREALRKADRTLTGDSPGLRGS

SEQ ID NO: 876550 - protein, 540 aa, Homo sapiens
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 876551 - protein, 166 aa, Homo sapiens
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTL

SEQ ID NO: 876552 - protein, 236 aa, Homo sapiens
RRVEAGPAAAVSVSVSRPLQRPAAAAGGAETVGCVPFGAAPAEKAPKKQRGGLCPARTRRAACAPPPRSLAARPRPGPSRAHRGPTERPRRPERAHLSPRAGAMAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVER

SEQ ID NO: 876553 - protein, 187 aa, Homo sapiens
PRGLPVAASRPLSSAASPLPRAKPIWSAEQAGAIGSGGSSHPSRIWAMAEPGEGLPEEVLALIFRHLSLRDRAAAARVCRAWAAAATCSAVWHDTKIRRPTRSVLDTLPPSLASTPLRTLQLRGPGAGRGRARARAGPQGTCPAHTRSRTGDFSCRTKKEIEGPRGVGLEPKSPTHLTPPHPTPPHP

SEQ ID NO: 876554 - protein, 355 aa, Homo sapiens [sequence omitted]

SEQ ID NO: 876555 - protein, 421 aa, Homo sapiens
PRGLPVAASRPLSSAASPLPRAKPIWSAEQAGAIGSGGSSHPSRIWAMAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHAVCGAASQLRHLDLRRLSFTLDDALVLQAARSCPELHSLFLDNSTLVGSVGPGSVLELLEACPRLRALGLHLASLSHAILEALAAPDRAPFALLALRCACPEDARASPLPNEAWVALRRRHPGLAVELELEPALPAESVTRVLQPAVPVAALRLNLSGDTVGPVRFAAHHYAATLCALEVRAAASAELNAALEELAARCAALREVHCFCVVSHSVLDAFRAHCPRLRTYTLKLTREPHPWRPTLVA

SEQ ID NO: 876556 - protein, 421 aa, Homo sapiens; identical to SEQ ID NO: 876555

SEQ ID NO: 876557 - protein, 421 aa, Homo sapiens; identical to SEQ ID NO: 876555

SEQ ID NO: 876558 - protein, 108 aa, Homo sapiens
PLPRAKPIWSAEQVRHQRPRLDGRKTRLWGFAILTRRGARKSYSCQTSVNQGGAPWRPEFSGTPGDPASRSLLPVGTQNGVPMGPRYKPGRTYLKPQETRGTNSGRNC

SEQ ID NO: 876559 - protein, 334 aa, Homo sapiens
FVTGFGAGRLRAGCRSSLRRTCPQEPRRRLRLGRPSGPRTMSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIFVLTIGVIICVFIIFLLIFIIINWAAVKAFWGAKASTPEVQSEQSSVRYKDSTSLDQLPTEMPGEDDALSEWNE

SEQ ID NO: 876560 - protein, 219 aa, Homo sapiens
RLRCSRGARRSRSPAPPPRRRLRLGRPSGPRTMSPRGTGCSAGLLMTVGWLLLAGLQSARGTNVTAAVQDAGLAHEGEGEEETENNDSETAENYAPPETEDVSHTECRQKTRTNFGTVQPVKHVVLRVRRSYYYTTWHALVVESKVVVRYGVRSNASGPTTTWMRLAVLTPPSISPTKILGEACVTHFAAMLIYTHISSPLRLRVSTHSAAPNLLTNKN

SEQ ID NO: 876561 - protein, 261 aa, Homo sapiens
FVTGFGAGRLRAGCRSSLRRTCPQEPRRRLRLGRPSGPRTMSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSGLCVFSRIADEKIKPTSH

SEQ ID NO: 876562 - protein, 268 aa, Homo sapiens
FVTGFGAGRLRAGCRSSLRRTCPQEPRRRLRLGRPSGPRTMSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSVNCKALSVMSPTCCLETVHRLSLLL

SEQ ID NO: 876563 - protein, 102 aa, Homo sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGRL

SEQ ID NO: 876564 - protein, 409 aa, Homo sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 876565 - protein, 409 aa, Homo sapiens; identical to SEQ ID NO: 876564

SEQ ID NO: 876566 - protein, 306 aa, Homo sapiens
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 876567 - protein, 306 aa, Homo sapiens; identical to SEQ ID NO: 876566

SEQ ID NO: 876568 - protein, 409 aa, Homo sapiens; identical to SEQ ID NO: 876564

SEQ ID NO: 876569 - protein, 306 aa, Homo sapiens; identical to SEQ ID NO: 876566

SEQ ID NO: 876570 - protein, 409 aa, Homo sapiens; identical to SEQ ID NO: 876564

SEQ ID NO: 876571 - protein, 306 aa, Homo sapiens; identical to SEQ ID NO: 876566

SEQ ID NO: 876572 - protein, 102 aa, Homo sapiens; identical to SEQ ID NO: 876563

SEQ ID NO: 876573 - protein, 99 aa, Homo sapiens
QGVLSALTPGFCCQGLEAWRWPLSQQESSKSSVCPGEGSWVGEVPRAAAAQTIPCQCQALTDPGVPGGGVLTARKGPVFEEQWNVLGTLCRHSSALLGL

SEQ ID NO: 876574 - protein, 69 aa, Homo sapiens
AWLCTVWPDPMLTHPLLLHIWFTHGRHGIQASSTSRAQPARPSGWNKHSEPEQHLGKGTTGHRGFQLEK

SEQ ID NO: 876575 - protein, 66 aa, Homo sapiens
ECERSRRHLERVDPRKSGESSSLACPGPSQLSLLESQPCDSSPPGPCFLNPTSDRWPEGECRRPLL

SEQ ID NO: 876576 - protein, 301 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 876577 - protein, 301 aa, Homo sapiens; identical to SEQ ID NO: 876576

SEQ ID NO: 876578 - protein, 301 aa, Homo sapiens; identical to SEQ ID NO: 876576

SEQ ID NO: 876579 - protein, 227 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 876580 - protein, 215 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGLGLE

SEQ ID NO: 876581 - protein, 261 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGESWTMGPGESLGRSPGSAESPGGDPHHLRDPVCHPLGAGLYQKGGQEANQ

SEQ ID NO: 876582 - protein, 122 aa, Homo sapiens
MLARLWGQADCCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 876583 - protein, 268 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGESWTMGPGESLGRWELKGEMRHTGTLDGKKGRGGSLGVWYHSSATYLGSLGKSLPLS

SEQ ID NO: 876584 - protein, 301 aa, Homo sapiens; identical to SEQ ID NO: 876576

SEQ ID NO: 876585 - protein, 301 aa, Homo sapiens; identical to SEQ ID NO: 876576

SEQ ID NO: 876586 - protein, 309 aa, Homo sapiens
MVRLPLQCVLWGCLLTAFAASVLDDFYLSAEEVATEISRSLQIAQFCFEVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 876587 - protein, 301 aa, Homo sapiens; identical to SEQ ID NO: 876576

SEQ ID NO: 876588 - protein, 122 aa, Homo sapiens; identical to SEQ ID NO: 876582

SEQ ID NO: 876589 - protein, 339 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGESWTMGPGESLGRSPGSAESPGGDPHHLRDPVCHPLGAGLYQPPTPSRNPRRSIFPTIFLAPTLLLQCRRLYMDANRSPRRMAKRVASQCRRDSEAAPTQECGHVGKQAVGQRAWCCCCCGVRVRGWH

SEQ ID NO: 876590 - protein, 175 aa, Homo sapiens
GWGRGVSRGLARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIDICQPHFPKDRGLNLLM

SEQ ID NO: 876591 - protein, 215 aa, Homo sapiens; identical to SEQ ID NO: 876580

SEQ ID NO: 876592 - protein, 46 aa, Homo sapiens
MASGALLEPGPEPLFLAVLAIGGQSRRGDLPWTTKNGWGWFNWRGS

SEQ ID NO: 876593 - protein, 1067 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 876594 - protein, 997 aa, Homo sapiens
RPPPAGPQAPEGARAGSRPVQLLALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 876595 - protein, 980 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETLLPELTNPDELLSYLDPPDLPSNSNDDLLSLFENN

SEQ ID NO: 876596 - protein, 1067 aa, Homo sapiens; identical to SEQ ID NO: 876593

SEQ ID NO: 876597 - protein, 134 aa, Homo sapiens
MARAVRGKAGEVQKPEPRAMVSVQPLPLSLCSKLPPAAAQAMDMCTSMYLQAWGGGGRVSGPAPDTALGCQPTLPALLHHHNLTQTPAHSSKSSLWPSLHRFAPSGLPLSRASWGACPVFTLFQAGLCPVSHMA

SEQ ID NO: 876598 - protein, 459 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPVCSSFQMGPTQAYNSQFMNQPGPRGPASMGGSMNPASMAAGMTPSGMSGPPMGMNQPRPPGISPFGTHGQRMPQQTYPGPRPQSLPIQNIKRPYPGEVSAAVGAWEVGTGTPGLEDMGRGYGFGRGVAWTPAHLDKEAGA

SEQ ID NO: 876599 - protein, 135 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAGRCPWGTLRCHWEVGRGTDYKPCLFAAPAFWCLHLSRCSANP

SEQ ID NO: 876600 - protein, 45 aa, Homo sapiens
MANANNPMNPGGNPMASGMTTSNPGLNSPQFAGQQQQFSAKAGPA

SEQ ID NO: 876601 - protein, 1067 aa, Homo sapiens; identical to SEQ ID NO: 876593

SEQ ID NO: 876602 - protein, 1067 aa, Homo sapiens; identical to SEQ ID NO: 876593

SEQ ID NO: 876603 - protein, 1195 aa, Homo sapiens
IVPEIAPLHSSLGDKSKTPSQKKEKRRNVCTCMCSSLSPGGHACPVLTCATHGKHPEAFPALSPVGYPRCSPTGPSKGLWNLPVLWPEGSWEAAQGWQAWRDPVTTSPFSSRLDNVHGSRVEPSETARMNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 876604 - protein, 1067 aa, Homo sapiens; identical to SEQ ID NO: 876593

SEQ ID NO: 876605 - protein, 1067 aa, Homo sapiens; identical to SEQ ID NO: 876593

SEQ ID NO: 876606 - protein, 1067 aa, Homo sapiens; identical to SEQ ID NO: 876593

SEQ ID NO: 876607 - protein, 123 aa, Homo sapiens
IVPEIAPLHSSLGDKSKTPSQKKEKRRNVCTCMCSSLSPGGHACPVLTCATHGKHPEAFPALSPVGYPRCSPTGPSKGLWNLPVLWPEGSWEAAQGWQAWRDPVTTSPFSSQAGQRSWLSGRT

SEQ ID NO: 876608 - protein, 206 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQVV

SEQ ID NO: 876609 - protein, 1393 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876610 - protein, 1393 aa, Homo sapiens; identical to SEQ ID NO: 876609

SEQ ID NO: 876611 - protein, 1305 aa, Homo sapiens
MVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876612 - protein, 1346 aa, Homo sapiens
MSTNKHEPALGRTEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876613 - protein, 1393 aa, Homo sapiens; identical to SEQ ID NO: 876609

SEQ ID NO: 876614 - protein, 409 aa, Homo sapiens [sequence omitted]

SEQ ID NO: 876615 - protein, 189 aa, Homo sapiens [sequence omitted]

SEQ ID NO: 876616 - protein, 154 aa, Homo sapiens [sequence omitted]

SEQ ID NO: 876617 - protein, 90 aa, Homo sapiens
AAAYYYYCSNSSFYRCTGICCHAPNPTLGCHLGVLDTERFLSQRFCCCHQRRMTVLEEEEWVQDHHIHQKGTLNRTLNLLYLPKLRIRDV

SEQ ID NO: 876618 - protein, 1053 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGK

SEQ ID NO: 876619 - protein, 206 aa, Homo sapiens; identical to SEQ ID NO: 876608

SEQ ID NO: 876620 - protein, 1393 aa, Homo sapiens; identical to SEQ ID NO: 876609

SEQ ID NO: 876621 - protein, 1139 aa, Homo sapiens
MTAITLYIQITFFFLLGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876622 - protein, 1288 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCFRLCFTAKGTLQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876623 - protein, 1358 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMVSTIERDQAKGHWMFS

SEQ ID NO: 876624 - protein, 337 aa, Homo sapiens
MWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 876625 - protein, 1111 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRLSESPIARIMVVNSTLLCSTLLTV

SEQ ID NO: 876626 - protein, 825 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCFRLCFTAKGTLRPPKCHHCRLSHFQGFLLKSY

SEQ ID NO: 876627 - protein, 462 aa, Homo sapiens
LYSQARRERREQLPGPGAAFVLGSANVASSVRLRCSFPLSLGGPSGPAAASVALGPAGPGRSLGRTPDTGDWEMDSVSFEDVAVAFTQEEWALLDPSQKNLYRDVMQEIFRNLASVGNKSEDQNIQDDFKNPGRNLSSHVVERLFEIKEGSQYGETFSQDSNLNLNKKVSTGVKPCECSVCGKVFICHSALHRHILSHIGNKLFECEECPEKLYHCKQCGKAFISLTSVDRHMVTHTSNGPYKGPVYEKPFDFPSVFQMPQSTYTGEKTYKCKHCDKAFNYSSYLREHERTHTGEKPYACKKCGKSFTFSSSLRQHERSHTGEKPYECKECGKAFSRSTYLGIHERTHTGEKPYECIKCGKAFRCSRVLRVHERTHSGEKPYECKQCGKAFKYSSNLCEHERTHTGVKPYGCKECGKSFTSSSALRSHERTHTGEKPYECKKCGKAFSCSSSLRKHERAYMW

SEQ ID NO: 876628 - protein, 462 aa, Homo sapiens; identical to SEQ ID NO: 876627

SEQ ID NO: 876629 - protein, 79 aa, Homo sapiens
GRLQGLVELVSATLPQGAHGLEAPRAERVVDGLGQGLHLLGEGVLQLGSRPWVTAPCAGRSAVAGGSPEASCGFSRSSC

SEQ ID NO: 876630 - protein, 410 aa, Homo sapiens
LPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTR

SEQ ID NO: 876631 - protein, 410 aa, Homo sapiens
MPRRKQEQPKRLPSPSEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTR

SEQ ID NO: 876632 - protein, 262 aa, Homo sapiens
MPRRKQEQPKRLPSPSEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSGSPQLKKSISFCFKVDNIWQLPSFLIINGR

SEQ ID NO: 876633 - protein, 143 aa, Homo sapiens
CRGRLAQLEEAAAAATMSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGAAQ

SEQ ID NO: 876634 - protein, 151 aa, Homo sapiens
CRGRLAQLEEAAAAATMSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGAGKSGVGAPMC

SEQ ID NO: 876635 - protein, 101 aa, Homo sapiens
QLSGSQTVRAGVRIHHLATVWLQSFWPGSRSLLLPSDAHLLYLPLYPVSSSELKWVPNGREPHCSSLKGVGPIFKYLRSFHCLVLQILTWQTLSPHHLQFP

SEQ ID NO: 876636 - protein, 109 aa, Homo sapiens
MLSVMRIRVESLQTGRSTMGRFTTCRTLGCPLPTLAVHVSFRLPQPVTRPLYPAWSKLWGRKKGLVRANPHRSRLAPTPFLRDQNLKRQSWLGTDVHACGLGTLGGRGG

SEQ ID NO: 876637 - protein, 102 aa, Homo sapiens [sequence omitted]

SEQ ID NO: 876638 - protein, 92 aa, Homo sapiens
SVTVPEAENPRDSLVLPPTQSSSDSSPPEVSGPSSSQMSMKTRRLSSASTGKPPLSVEDDFEKLTWEISGGKLEAEIDLDPGKDEDDLPLEL

SEQ ID NO: 876639 - protein, 132 aa, Homo sapiens [sequence omitted]

SEQ ID NO: 876640 - protein, 96 aa, Homo sapiens
HCAWPICLVLEASSPAGPTAYPVLQSAGFALPVRGARAQQGHCSWESTGRQSLPPPPHQPRSVSAGLAPRTEHWLMPRSRIQTLMLPPTSFVILGK

SEQ ID NO: 876641 - protein, 164 aa, Homo sapiens
RARPGPGREERGGGVGTRSRRTAARANSPEEEVVRGAEGGAELLPFPRDRGPCTLAQMAMRSALARVVDSTSELVSVEQTLLGPLQQERSFPIHLKDSVEFRNICSHLALQIEGQQFDRDLNAAHQCLKTIVKKLIQSLANFPSDAHMVACASLRQILQNLPDI

SEQ ID NO: 876642 - protein, 146 aa, Homo sapiens
FTTGEQDTVMDQKLIPEFIKKIQEAASQGLKFVGVIPQYHSSVNSAGSSAPVSTANSTEDARDAKNARGDHASLENEKPGTGDVCYQQGFSLAALHPFVQPTHEREKTPLEHIFRAILIKKTDRSQKTDLHNEGYILELDCCSSLD

SEQ ID NO: 876643 - protein, 302 aa, Homo sapiens
MEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 876644 - protein, 578 aa, Homo sapiens
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 876645 - protein, 578 aa, Homo sapiens; identical to SEQ ID NO: 876644

SEQ ID NO: 876646 - protein, 541 aa, Homo sapiens
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEHSGQIHGHPGLQTKAAVHPTSCGAVSIPCSYLVT

SEQ ID NO: 876647 - protein, 578 aa, Homo sapiens; identical to SEQ ID NO: 876644

SEQ ID NO: 876648 - protein, 563 aa, Homo sapiens
HGRKAVLPLRPPWPLWGSLQLMYCDGAVDLDAAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 876649 - protein, 425 aa, Homo sapiens
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNGCRSADRLRAPAELAGGLWLAAHLCATNSRRQDYQRGECIHQADCLSSETVSTSENQEEGIEVSVAILQRRNAQQADEEIKR

SEQ ID NO: 876650 - protein, 578 aa, Homo sapiens; identical to SEQ ID NO: 876644

SEQ ID NO: 876651 - protein, 473 aa, Homo sapiens
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKVTYGNKSSMS

SEQ ID NO: 876652 - protein, 107 aa, Homo sapiens
MLRSVVNQTLYSSCPHSSGGDKQVKLLINRAVEDISPLAEWKGTSEVPGHREQRLFPSPSDLQLWRGVFRGVVVYLEWDEKLCCPKCFLFQGKISMAGYEEWGLQTS

SEQ ID NO: 876653 - protein, 246 aa, Homo sapiens
RVWAGRSWGRVQRPEGLRLPGWPRSQRRVPRCRPGIWGLWCLSVSLSARTQLLQPQARPGQGVGASGAGLERSSARWCGQRRGTAALAAASPQVIILLQVSSGLRWLRVCAMVDILGERHLVTCKGATVEAEAALQNKVVALYFAAARCAPSRDFTPLLCDFYTALVAEARRPAPFEVVFVSADGSSQEMLDFMRELHGAWLALPFHDPYRQRSLALLPRLECSGVILAHCNLCLLGSSDSLALAS

SEQ ID NO: 876654 - protein, 250 aa, Homo sapiens
RVWAGRSWGRVQRPEGLRLPGWPRSQRRVPRCRPGIWGLWCLSVSLSARTQLLQPQARPGQGVGASGAGLERSSARWCGQRRGTAALAAASPQVIILLQVSSGLRWLRVCAMVDILGERHLVTCKGATVEAEAALQNKVVALYFAAARCAPSRDFTPLLCDFYTALVAEARRPAPFEVVFVSADGSSQEMLDFMRELHGAWLALPFHDPYRHHCCELREGKILKRSWTLRECSCSPPAPSVSCILRVCAH

SEQ ID NO: 876655 - protein, 256 aa, Homo sapiens
RVWAGRSWGRVQRPEGLRLPGWPRSQRRVPRCRPGIWGLWCLSVSLSARTQLLQPQARPGQGVGASGAGLERSSARWCGQRRGTAALAAASPQVIILLQVSSGLRWLRVCAMVDILGERHLVTCKGATVEAEAALQNKVVALYFAAARCAPSRDFTPLLCDFYTALVAEARRPAPFEVVFVSADGSSQEMLDFMRELHGAWLALPFHDPYRHSRSQLIHAATFSPCLHFLFQAIWWKQSNCLQNHPKASLGRSWWN

SEQ ID NO: 876656 - protein, 95 aa, Homo sapiens
DSKRKRLDLLLDCTIQYGCTSTFQVDSGYCIVQIWNISIITETVIGQCCLRDVGCRTSTRRPGYQTPAFKFLPSAVECGRPLEVQYLNMLVTTVY

SEQ ID NO: 876657 - protein, 172 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRLTTSLSRRHLMLTYLPLRCVTQILLCAMWTLPSHATTRELTQWV

SEQ ID NO: 876658 - protein, 73 aa, Homo sapiens
MVDFRGLHSPLLLFATAMKNNWRDYSKTKRKWTFLQVKIEIHILRWHQVLRGILDPGRVLLVQHLFGEPYLQT

SEQ ID NO: 876659 - protein, 104 aa, Homo sapiens [sequence omitted]

SEQ ID NO: 876660 - protein, 112 aa, Homo sapiens
MTSPFTPKTQGQSLLQSPGKGGVRWWGAKGQEMEHRPSPPHLCPLRPWATSNLLQIFPSRGPHPSPPPDHPSRSHHVSQTPGSFRFTPSPCSQHPHQDPTTPTPALSGSLLS

SEQ ID NO: 876661 - protein, 161 aa, Homo sapiens
MAKEEPQSISRDLQELQKKLSLLIDSFQNNSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSADFEGLYQE

SEQ ID NO: 876662 - protein, 161 aa, Homo sapiens; identical to SEQ ID NO: 876661

SEQ ID NO: 876663 - protein, 185 aa, Homo sapiens
MAKEEPQSISRDLQELQKKLSLLIDSFQNNSKLPQHSRISLDSDDGVSRLGSAGSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSADFEGLYQE

SEQ ID NO: 876664 - protein, 157 aa, Homo sapiens
CLEGGLSFLTPSQSCGKGHSLSLSFLSCQPLRACSSGSESQWEQARFAKPWAPGLGAPLPDPSGHGRGEPRGEEPRGGARARGRRQAALAPSRDALSFFLLFLLLPLFASPANAVGAARRSGAGYPPSACPPSRYEDGRSSRRTRWMKTTNGFCFLW

SEQ ID NO: 876665 - protein, 89 aa, Homo sapiens
PRWRSILTGVLLPPFPGEPICSPHCGSLDCKDQVTQGASNKDACGFELERSQDLRQRKGPAHILCGDSHGSSASLSLSAAPTQQDLTGL

SEQ ID NO: 876666 - protein, 161 aa, Homo sapiens; identical to SEQ ID NO: 876661

SEQ ID NO: 876667 - protein, 161 aa, Homo sapiens; identical to SEQ ID NO: 876661

SEQ ID NO: 876668 - protein, 185 aa, Homo sapiens; identical to SEQ ID NO: 876663

SEQ ID NO: 876669 - protein, 163 aa, Homo sapiens
MAKEEPQSISRDLQELQKKLSLLIDSFQNNSKLPQHSRISLDSDDGVSRLGSAGSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRSHEI

SEQ ID NO: 876670 - protein, 232 aa, Homo sapiens
MGSVLSTDSGKSAPASATARALERRRDPELPVTSFDCAVCLEVLHQPVRTRCGHVFCRSCIATSLKNNKWTCPYCRAYLPSEGVPATDVAKRMKSEYKNCAECDTLVCLSEMRAHIRTCQKYIDKYGPLQELEETAARCVCPFCQRELYEDSLLDHCITHHRSERRPVFCPLCRLIPDENPSSFSGSLIRHLQVSHTLFYDDFIDFNIIEEALIRRVLDRSLLEYVNHSNTT

SEQ ID NO: 876671 - protein, 121 aa, Homo sapiens [sequence omitted]

SEQ ID NO: 876672 - protein, 121 aa, Homo sapiens [sequence omitted]

SEQ ID NO: 876673 - protein, 117 aa, Homo sapiens
MGSVLSTDSGKSAPASATARALERRRDPELPVTSFDCAVCLEVLHQPVRTRCGHVFCRSCIATSLKNNKWTCPYCRAYLPSEGVPATDVAKRMKSEYKNCAECDTLVCMSLLSEGTV

SEQ ID NO: 876674 - protein, 3957 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEAQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSARPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQLESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876675 - protein, 3957 aa, Homo sapiens; identical to SEQ ID NO: 876674

SEQ ID NO: 876676 - protein, 3924 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEAQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSARPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQLESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876677 - protein, 3955 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEAQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSARPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQLESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKELTEELGELEASSDEEAMVTTRVVRRRVIIQGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876678 - protein, 422 aa, Homo sapiens
MASWGGKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876679 - protein, 2358 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQKNTTYQNKERSEITQRYLKIVQMLQIN

SEQ ID NO: 876680 - protein, 1872 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876681 - protein, 3985 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEAQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSARPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQLESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEVTLCEPSILSSTSQFQAEPVEGRRVSKVVKTTVVLGERMEKHLGDSSLATDLPSAKDDFEEDNNE

SEQ ID NO: 876682 - protein, 2507 aa, Homo sapiens
MASWGGKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEAQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSARPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQLESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 876683 - protein, 1836 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHTPR

SEQ ID NO: 876684 - protein, 83 aa, Homo sapiens
EKKHPTWGGKEGLGKTPERHPSNKAGREKDSPSGWVEDARKGLNHGLLGITALPFLRSPCGLALELVLTGTLANRVVFFTRVI

SEQ ID NO: 876685 - protein, 703 aa, Homo sapiens
FIHAGLIFVVIAVPAADLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876686 - protein, 696 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876687 - protein, 738 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876688 - protein, 464 aa, Homo sapiens
WLGGGWGQSAEGRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876689 - protein, 547 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876690 - protein, 633 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEIQGCWRLRKFAPGGSLKQWVPRPWFLLDFGPNERCGT

SEQ ID NO: 876691 - protein, 777 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVARGRQQLTLHEHTTAGPLPQAEGTRSAATTHAPGPHDTSVTQLAMLSNKTAVHETWDGHARSTDNHNAPQLRPEPRRTQEGTTKAPRHRKQTYQTTMLAHKHSARQITTTQTHQSAGHRRAPTMRLDPHSLPGTVLRWAHPTWNHAATQWSPHADTKPYTKVAPTGQRRTDTFMLADRSTPGPTRDAQPDLNSQRPLTHPNHNPTLTHTITQERHFTPNTSLHTLTRGTITRNHTRHRT

SEQ ID NO: 876692 - protein, 738 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVVSGDPTPRAHRFPACAKEDTKRDGCCQRRTLSGRGRSPGGWERGGHRSDVPPTLSQDWKEQYIHENYSRALEGEGIVEQPCPDVYWFPLLSEQMCDELVAEMEHYGQWSGGRHEVRAWARRAEAFPEEEVQDLVNKQWNQENGSKEGFPGGRQTLGSQLHSFMYSRNIYCWAQWLMPVILALWEAEAGGLLEQGEFEASL

SEQ ID NO: 876693 - protein, 569 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSTHPLASAAPAPRSPRSGRSTHRGSGPPEVGPQLAVAGQHGGDHLPVLLNE

SEQ ID NO: 876694 - protein, 738 aa, Homo sapiens; identical to SEQ ID NO: 876687

SEQ ID NO: 876695 - protein, 689 aa, Homo sapiens [sequence omitted]

SEQ ID NO: 876696 - protein, 426 aa, Homo sapiens
HFSSCEVVLELRPGVSDVGFMEDLVVVQEKGDPVGGILQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876697 - protein, 435 aa, Homo sapiens
HLSPIQPLLGLPIRILAAPMLSLLPLPAHPDSREPGEGRIDTASLLFSWGHGPVTPSTPPPHLPPSQLPLTSRDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876698 - protein, 305 aa, Homo sapiens
MTSSGPGPRFLLLLPLLLPPAASASDRPRGRDPVNPEKLLVITVATAETEGYLRFLRSAEFFNYTVRGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 876699 - protein, 554 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVVSGDPTPRAHRFPALC

SEQ ID NO: 876700 - protein, 124 aa, Homo sapiens [sequence omitted]

SEQ ID NO: 876701 - protein, 1106 aa, Homo sapiens [sequence omitted]

SEQ ID NO: 876702 - protein, 972 aa, Homo sapiens [sequence omitted]

SEQ ID NO: 876703 - protein, 972 aa, Homo sapiens [sequence omitted]

SEQ ID NO: 876704 - protein, 972 aa, Homo sapiens [sequence omitted]

SEQ ID NO: 876705 - protein, 1106 aa, Homo sapiens [sequence omitted]

SEQ ID NO: 876706 - protein, 1106 aa, Homo sapiens [sequence omitted]

SEQ ID NO: 876707 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 876708 - protein, 459 aa, Homo sapiens
MRATVILSSTPRSCLTTRSGSSPGTTCSLVRWQLITPQLPITGPVGVAGSPWALGQRPFGAQGLKGPVCVAGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 876709 - protein, 117 aa, Homo sapiens
MVLASCLLCQLVEPSFLIPLSSWKWTDFMPMKSPGATLILRKPGSLGLDRLAESEISLSERSSRCSQTTLSSGPLEQDGSSKNLTGPLSLCPIRRLHSTASPLPPPYWYCCNEPSGS

SEQ ID NO: 876710 - protein, 1106 aa, Homo sapiens; identical to SEQ ID NO: 876707

SEQ ID NO: 876711 - protein, 122 aa, Homo sapiens
LGDLEYPRFDASAEELTTGSTTLPSSKLQLLHGWGDTGRTYKLCLRSFHSTARPSSETWEGEGFRGGQRIPLPEHGPSLPVRGWGLSPHPPLPYCSHGVGLVFAMPTSRTFFPNPLIFMEMD

SEQ ID NO: 876712 - protein, 1106 aa, Homo sapiens; identical to SEQ ID NO: 876707

SEQ ID NO: 876713 - protein, 901 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPDFLIPPVAKGPFPAAFAFSSSSFFCSSFGFCLKAL

SEQ ID NO: 876714 - protein, 511 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINGDEHAPRHVPAPSPPCPRSLSLPALSTHPWEEWEREPGTQEMDSRPLTHCRVNLASGPQFPQLYKEAIWLDWCFQNFRHLGTKAMIFPSHIPLILYY

SEQ ID NO: 876715 - protein, 218 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQGEPPFWPD

SEQ ID NO: 876716 - protein, 1106 aa, Homo sapiens; identical to SEQ ID NO: 876707

SEQ ID NO: 876717 - protein, 1251 aa, Homo sapiens
MLLSFSICVLFFKGKILILNLVLLTHRLCGLSRVWVPAHRECGVGHMRLTQTQTPRQVPSALSLIHSSVKWGFSLSHPSLEAGGPRPWAWFPKVGSEQAFLAPQSLALSRAGGCGAAGLLQGSGAEASHCLHHVLWLWLSAGTPSPPLRPQARIEAGVLCDRQLLEPRFQVQVSHDQAPGRRRADRVSKSVRARSEEKVEKREEEEEEEERKLEGTAARLKGEEEDQPKEEEEENKTNSQCRGEERVSSVPIPAELVAESSVPWAPCSPAPACHFPTEAMGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 876718 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 876719 - protein, 1106 aa, Homo sapiens; identical to SEQ ID NO: 876707

SEQ ID NO: 876720 - protein, 342 aa, Homo sapiens [sequence omitted]

SEQ ID NO: 876721 - protein, 1106 aa, Homo sapiens; identical to SEQ ID NO: 876707

SEQ ID NO: 876722 - protein, 1106 aa, Homo sapiens; identical to SEQ ID NO: 876707

SEQ ID NO: 876723 - protein, 1086 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDDPITSLTQVPRSTFVYVS

SEQ ID NO: 876724 - protein, 766 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESGVGCSQRRWMQSAALDAVCGVGCSQRRWIQ

SEQ ID NO: 876725 - protein, 116 aa, Homo sapiens
PCPQPNFNLSSGNSMAGTVPRPEAPPHRLASFGIQLVPCPQGPAPDGHPYAESGYVRLLGEVGTLQFAELHRSRTLQVVFEAYPPPTVLWFKDNRTLGDSSAGEIALSTRNVSETR

SEQ ID NO: 876726 - protein, 1106 aa, Homo sapiens [sequence omitted]

SEQ ID NO: 876727 - protein, 1106 aa, Homo sapiens [sequence omitted]

SEQ ID NO: 876728 - protein, 1106 aa, Homo sapiens [sequence omitted]

SEQ ID NO: 876729 - protein, 972 aa, Homo sapiens [sequence omitted]

SEQ ID NO: 876730 - protein, 972 aa, Homo sapiens [sequence omitted]

SEQ ID NO: 876731 - protein, 76 aa, Homo sapiens
MPTRYASGHYQRVLWVAKLPLVVNHKHFHPGDFTDMKLAGEGPRWPGHTHPVPAAQRECPPRTWGTEKHLRYVGDE

SEQ ID NO: 876732 - protein, 231 aa, Homo sapiens
TTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVCYDC

SEQ ID NO: 876733 - protein, 112 aa, Homo sapiens
MGTGKSSSFFAEPAGCGHQNESGPSRCQGLDLPPCIRQAAHTPRKSARSLRQSDSRAQRPTRDALKEVTFRGCYSQTRPSSTRRIYVGSDPCKHRRDRASGWEHATVPPTAT

SEQ ID NO: 876734 - protein, 119 aa, Homo sapiens
MPHCGPPTLRPPAPTSVIVLMSSPSHFQPLPSIPGALTQDPTWSRDAGSPPWGLVLAHPAGIAHRLPDTPPEGGTRFSAAAFTAAPAPSAGPPSSLCTLLAEGWETLQDIPTLPHAAKL

SEQ ID NO: 876735 - protein, 415 aa, Homo sapiens
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876736 - protein, 415 aa, Homo sapiens; identical to SEQ ID NO: 876735

SEQ ID NO: 876737 - protein, 415 aa, Homo sapiens; identical to SEQ ID NO: 876735

SEQ ID NO: 876738 - protein, 587 aa, Homo sapiens
MREETVRVFALDKNFHMKCYKCEDCGKPLSIEADDNGCFPLDGHVLCRKCHTARAQTCVRTGPLQTAVHAPLWTTHTETTCPAEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876739 - protein, 415 aa, Homo sapiens; identical to SEQ ID NO: 876735

SEQ ID NO: 876740 - protein, 441 aa, Homo sapiens
MAAPRPSPAISVSVSAPAFYASLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876741 - protein, 398 aa, Homo sapiens
MTKNDPFKARVSSGYVPPPVATPFSSKSSTKPAAGGTAPLPPWKSPSSSQPLPQVPAPAQSQTQFHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPVRTKTRCAPWGPRSPDSEGGGGAGAVTSSYAGHGASQRQMWLSTNSADDAKTLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876742 - protein, 415 aa, Homo sapiens; identical to SEQ ID NO: 876735

SEQ ID NO: 876743 - protein, 190 aa, Homo sapiens
HASADRVGLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876744 - protein, 244 aa, Homo sapiens
RSSTYFLLFTAVFSGLPRTLRPMPSTPGPGAASRPRSRAAVPHRLLHLPPVCAAAPGPAVLQSGGGAVLRGLLHCESGCAGLCWAVLGSRALEACCGVPVPCQPPPAASSDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876745 - protein, 127 aa, Homo sapiens
MAAPRPSPAISVSVSAPAFYAPQKKFGPVVAPKPKVNPFRPGDSEPPPAPGAQRAQMGRVGEIPPPPRGRLSPASTSPCWGWRRCRGCSGRCLPAAPSPDRGIISPCASGGGDLPFPAASSGGGGRA

SEQ ID NO: 876746 - protein, 119 aa, Homo sapiens; identical to SEQ ID NO: 876734

SEQ ID NO: 876747 - protein, 135 aa, Homo sapiens
MTKNDPFKARVSSGYVPPPVATPFSSKSSTKPAAGGTAPLPPWKSPSSSQPLPQVPAPAQSQTQFHVQPQPQPKPQVQLHVQSQTPPEGGTRFSAAAFTAAPAPSAGPPSSLCTLLAEGWETLQDIPTLPHAAKL

SEQ ID NO: 876748 - protein, 211 aa, Homo sapiens
MCPHQWPLHSVPSPVPSLQPGAQHPCLLGSPLPAPSLCPRFRLRLRARHSSMFSPSPSPSLRSNSMSSPRPSLCLWLTPSPVPPPAQNQNQVRSPGAPGPLTLKEVEELEQLTQQLMQDMEHPQRQNVAVNELCGRCHQPPSFTMPSRGRSPECRRSSTPCPLEGTSFIVDQANRPHCVPDYHKQYAPRCSVCSEPIMLSWREETSMAPDR

SEQ ID NO: 876749 - protein, 219 aa, Homo sapiens
MITHVRSSVLISYGGVVPFSVSGLVVLTVTQSLRTRRRGGHPRRGAHAPACAARPGHGGPPPVSRDLRFGLGSGFLRPAEEVRPCGGPKAQSESLPARGQRASPGTRGPARTDGPGGRDSPAAPPEDFLPCRPSFPRCWSDWLSRVTRCGDSEWRGVAFPRHDALLRLNYVRRYTSSSLMHVILAQRSALVNPIMHTGETVSAQRKGSEYRHRQNRADQ

SEQ ID NO: 876750 - protein, 119 aa, Homo sapiens; identical to SEQ ID NO: 876734

SEQ ID NO: 876751 - protein, 259 aa, Homo sapiens
MAAPRPSPAISVSVSAPAFYAPQKKFGPVVAPKPKVNPFRPGDSEPPPAPGAQRAQMGRVGEIPPPHDDPRKDYACLDSTVLGMPDDADGDSCEGLHVCARNYARGHVLHLLARRSLTLDVGPIFASWLTSAPVFRASWFFHSFWWGNWFWVHLPVMATSLRLIDAKKSKLEFSIYPSTPRFAQLIARALQLRSFTTQSSLEHSDCAFMGRTMRPMYDTRVVATSHFERQTLTTLIDLIRHIGLSTNASRRLRTPKGPE

SEQ ID NO: 876752 - protein, 415 aa, Homo sapiens; identical to SEQ ID NO: 876735

SEQ ID NO: 876753 - protein, 520 aa, Homo sapiens
LHHSSAVRPAFPDLPAEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876754 - protein, 415 aa, Homo sapiens; identical to SEQ ID NO: 876735

SEQ ID NO: 876755 - protein, 415 aa, Homo sapiens; identical to SEQ ID NO: 876735

SEQ ID NO: 876756 - protein, 412 aa, Homo sapiens
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPVRTKTRCAPWGPRSPDSEGGGGAGAVTSSYAGHGASQRQMWLSTNSADDAKTLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876757 - protein, 440 aa, Homo sapiens
GRVGDHEPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPVRTKTRCAPWGPRSPDSEGGGGAGAVTSSYAGHGASQRQMWLSTNSADDAKTLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876758 - protein, 120 aa, Homo sapiens
MCPHQWPLHSVPSPVPSLQPGAQHPCLLGSPLPAPNRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 876759 - protein, 391 aa, Homo sapiens
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDGLGNVAPWHDFHWMFHVSWGALSVSLIRLS

SEQ ID NO: 876760 - protein, 119 aa, Homo sapiens; identical to SEQ ID NO: 876734

SEQ ID NO: 876761 - protein, 115 aa, Homo sapiens
MLHQDENTPPHLYTPTPASVVPMIKQDTPTPDHQASKMVQETYAKLQNQHHKRNQKSEQYSTEDRSEQGLSVIKSRHDNHHSDRLETTYQYTDDKKVIDDKSKKIDKDSQIRHTK

SEQ ID NO: 876762 - protein, 97 aa, Homo sapiens
LLDDMTKNDPFKARVRDRRVGKAGLRARETGHRTKEDGVLLTASLFPLPPLAGVIWICAPTSGHSIQFQVQYQACSRGHSTPASLEVPFQLPASAPG

SEQ ID NO: 876763 - protein, 212 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETIGRILLENPKGFIGPK

SEQ ID NO: 876764 - protein, 303 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETLERSRKGIADGCIDLEEYDGDSYQNEGHYDEPERVKTQQERGSDEMKNREGKRTETTTQDSPAPDREGNTGPGCDSTKKEEAKEERTMNNGQRHNSAKQHARTDPTK

SEQ ID NO: 876765 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 876766 - protein, 315 aa, Homo sapiens; identical to SEQ ID NO: 876765

SEQ ID NO: 876767 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 876768 - protein, 315 aa, Homo sapiens; identical to SEQ ID NO: 876765

SEQ ID NO: 876769 - protein, 315 aa, Homo sapiens; identical to SEQ ID NO: 876765

SEQ ID NO: 876770 - protein, 353 aa, Homo sapiens
GAVNGGERMCCPRGGFDDQYPQLIIVPDNRNEMLPDSLCHQTVYDLCRPYPHSRDRRTRCYQYTRVRRRCSSSNGYHYDGSYFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 876771 - protein, 315 aa, Homo sapiens; identical to SEQ ID NO: 876765

SEQ ID NO: 876772 - protein, 315 aa, Homo sapiens; identical to SEQ ID NO: 876765

SEQ ID NO: 876773 - protein, 161 aa, Homo sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLGKGQDVSLAGTVVLSQRNKWVTQ

SEQ ID NO: 876774 - protein, 200 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQGNNGKI

SEQ ID NO: 876775 - protein, 315 aa, Homo sapiens; identical to SEQ ID NO: 876765

SEQ ID NO: 876776 - protein, 315 aa, Homo sapiens; identical to SEQ ID NO: 876765

SEQ ID NO: 876777 - protein, 315 aa, Homo sapiens; identical to SEQ ID NO: 876765

SEQ ID NO: 876778 - protein, 297 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 876779 - protein, 262 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEGDCYYKLFKT

SEQ ID NO: 876780 - protein, 315 aa, Homo sapiens; identical to SEQ ID NO: 876765

SEQ ID NO: 876781 - protein, 315 aa, Homo sapiens; identical to SEQ ID NO: 876765

SEQ ID NO: 876782 - protein, 315 aa, Homo sapiens; identical to SEQ ID NO: 876765

SEQ ID NO: 876783 - protein, 104 aa, Homo sapiens
MDLRQFLMCLSLCTAFALSKPTEKKDRVHHEPQLSDKVHNDAQSFDYDHDAFLGAEEAKTFDQLTPEESKERLGEDVSKIDGDKPVLVSDTSSRVEVEGPFEES

SEQ ID NO: 876784 - protein, 109 aa, Homo sapiens
MPRISGMVCVQTKPCHFSSVGAQRGNAPPAPSTEILPIHQTIPLLIFLPPGASDSRKSDWREHTLRCTLSSSIEPGVTLRDSGHLTRLYQEQRLQLVESTGCREMVTRK

SEQ ID NO: 876785 - protein, 125 aa, Homo sapiens
MESSGSHSTTVKIHGSHDGAKIPMCLPLSLWPPPRLLPQPQIVPWPHEAALELKSHSLVMIIRERSSQGLPGPQRRGTEHKEAGGHAWGLGTSPGRVIYGLDLLSAAALLMENIKIICCCRQCEG

SEQ ID NO: 876786 - protein, 84 aa, Homo sapiens
EGDAKGDKAKVKDEPQRRSARLSAKPAPPKPEPKPRKSPVKKGEKVPKGKKGKADAGKEGNNPAENGDAKTDQAQKAEGAGDAK

SEQ ID NO: 876787 - protein, 70 aa, Homo sapiens
PGGVLLQRQLPGEKELNAQGTEVQGMPPGPGTHGAPESPILQQKGLTGLGQYLLPNTGHGLTKKLGACAL

SEQ ID NO: 876788 - protein, 292 aa, Homo sapiens
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRVSEITTFLYYFLYLVYILLYVDCFVFLQEY

SEQ ID NO: 876789 - protein, 221 aa, Homo sapiens
NLVGARIPRGKVITTARGSSTGELEGHASSRLPPQPCGWGQSSDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAENGSPEEHAIYVGIIFIAQAAAEN

SEQ ID NO: 876790 - protein, 209 aa, Homo sapiens
MNRLLIFLIPWKDLNMLLMKIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRVSEITTFLYYFLYLVYILLYVDCFVFLQEY

SEQ ID NO: 876791 - protein, 300 aa, Homo sapiens
NLVGARIPRGKVITTARGSSTGELEGHASSRLPPQPCGWGQSSDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRVSEITTFLYYFLYLVYILLYVDCFVFLQEY

SEQ ID NO: 876792 - protein, 112 aa, Homo sapiens [sequence omitted]

SEQ ID NO: 876793 - protein, 105 aa, Homo sapiens
MAPRWPCVCCDTCGWRPSIWLWQCLVRAALPLDPGKWHPRPCILMAACWSLLAMPTPTGARGLWSQHTPTSQSAGPSQACFPRGPLGACVSVPGPEMWPSSGHLP

SEQ ID NO: 876794 - protein, 70 aa, Homo sapiens
VEAEPRHSRNPARFVQAQGSADVPAPCHLRPLQTFGSDEHKREVEVGLRVAQHWPEGTPQLEQPQQCGHS

SEQ ID NO: 876795 - protein, 130 aa, Homo sapiens
AFPACPPLLSGLSSGAPSALHHMFIQSVSPQILKWLCYQPGTTLNTEFSFPNQRPQLETSEVPSSFNLVSPTWALPSALQPTSTYPAPPHTIPYFHSLSLPASGFSSLHATPACPAEHSSPPCWLLWTHL

SEQ ID NO: 876796 - protein, 123 aa, Homo sapiens
FLCPFRTTPTPAFQLLMLAGLSQTARAPTPNKEEGQALGGRLQADRQHLRPRYLGTPQKSAEQASRHFREPAGPAPFAVADQLPPEDRTLQRRAGSEPQLFLSATALSKMRTSTASCRSTWRM

SEQ ID NO: 876797 - protein, 349 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 876798 - protein, 238 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELEREREISSSSW

SEQ ID NO: 876799 - protein, 85 aa, Homo sapiens
EGTVSAKRLLVGTCLVASEGACRWLWLKQAPARVCRRETAMDDQGCPRCKTTKYRNPSLKLMVNVCGHTLWMIQERDKQKPRCLL

SEQ ID NO: 876800 - protein, 210 aa, Homo sapiens
MCADTLFFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 876801 - protein, 344 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGWSLALSPRLECSGVILARCDLHLPGSSDSPASAS

SEQ ID NO: 876802 - protein, 349 aa, Homo sapiens; identical to SEQ ID NO: 876797

SEQ ID NO: 876803 - protein, 307 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELGQHISLAPIHKLEEALYEYQPLQIETYGPHVPELEMLGRLGYLNHVRAASPQDLAGGYTSSLACHRALQDAFSGLFWQPS

SEQ ID NO: 876804 - protein, 89 aa, Homo sapiens
GAGGENERHVACTGAGSFAWFCASLKKNVFKPCQSCLTTGPCWRLYFFSCLSQSTTGCIQWAFLAAQLTIYKIWTLELNQGASKSKADL

SEQ ID NO: 876805 - protein, 307 aa, Homo sapiens; identical to SEQ ID NO: 876803

SEQ ID NO: 876806 - protein, 302 aa, Homo sapiens
GCGKSISISTALTAATLLLFPATCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 876807 - protein, 318 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGGFDTISLI

SEQ ID NO: 876808 - protein, 313 aa, Homo sapiens
EGTVSAKRLLVGTCLVASEGACRWLWLKQAPARVCRRETAMDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYVS

SEQ ID NO: 876809 - protein, 251 aa, Homo sapiens
MPWMSLTQALPNVAHQNPSHLAPGTFSPSRLHAGRGPGVSAGGSGAFAGTWALHPDLLRAWSFRSILNLLQASDSLLCSWPMETGTLRPGLRLRCLGCAGAFGALLVHPTWGPCPAVHCARVLSPCLSVTGCSLPFPSQPQYQPLGIREALPDQPKVHSRGCQFKFLHSNFLVYFGYLSSPSCPLSLPYKLSESRGHISSSCPQLCCLYQPGYAVQRLTVNSCRPRIPSACCALILAYIFGSSEFFSLSPS

SEQ ID NO: 876810 - protein, 103 aa, Homo sapiens
RHSPTTATSPKVQVRPHSLRSAWPTPTPRSESPFIQGNDQQDYHKENHGEKSQRAFWALGRCLSSGTSGKNSKSDPICQAHLITHTAVIFFSDSKMQGFPEPC

SEQ ID NO: 876811 - protein, 408 aa, Homo sapiens
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 876812 - protein, 430 aa, Homo sapiens
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 876813 - protein, 104 aa, Homo sapiens
SHSSGDQKSKIQVSAGPCPSATCRGGFFLPFPGCWWQPATLGGPGPTATGAFLSLCFSFFLRQSRSVIQAGVQWGNLGSLQPPPPGFRQLFCLSHPSSCNCRHL

SEQ ID NO: 876814 - protein, 81 aa, Homo sapiens
RHEARQEAAHLVGLGYESFLAGARWVLSILWPDLLIRLLQHRFTKYSPQASSIIWELRKKPALLSQKLGMWPRQSFTKTSR

SEQ ID NO: 876815 - protein, 121 aa, Homo sapiens
QQGDPHNRLWNQHTEARKKRHTSPRWALWRLMVETRLQRPKGSWYLVISRINCHHVFSRQQRPVSSTCTVSHHSLGHLAHKIDLGEIIQFHFTFSCFGTLPAATSVLPEVRKLWTRHLLLL

SEQ ID NO: 876816 - protein, 158 aa, Homo sapiens
QRSRDMAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 876817 - protein, 127 aa, Homo sapiens
LRQTQTISFRSEKIIRLIEKPGGYYSTPPDEEAEETRPLHHLVATSDTLHEAAGKDNSQNLSTKAIPRAAAATTSTFFLSQPPIFSTQPSLWIAFSLKLIPQPTVTLMQQESGTRFFDMEGIFSQSV

SEQ ID NO: 876818 - protein, 112 aa, Homo sapiens
LRQTQTISFRSEKIIRLIEKPGGYYSTPPDEEAEETRPLHHLVATSDTLHEAAGKDNSQNPAPNLLHTALLMDRLLVEINPTAHSNINAAGVGDSVLRHGRDFLPICVVSSP

SEQ ID NO: 876819 - protein, 158 aa, Homo sapiens; identical to SEQ ID NO: 876816

SEQ ID NO: 876820 - protein, 116 aa, Homo sapiens
VYLPLYWQLTFPYSQVTVKYLGTCTKFYKQYKYLRVLIGRPLVLAAGRSDSGGRRVWGTPQRWASWRPETTGTEVGHLFPESGLEISELPILRPSSGERVPGSQESWALPLTSWRP

SEQ ID NO: 876821 - protein, 116 aa, Homo sapiens; identical to SEQ ID NO: 876820

SEQ ID NO: 876822 - protein, 116 aa, Homo sapiens; identical to SEQ ID NO: 876820

SEQ ID NO: 876823 - protein, 74 aa, Homo sapiens
RSRDMAPGSRGERSSFRSRRGPGVPSPQPDVTMLSRLLKEHQAKQNERKELQGAKYPVGRFLFGRGLASARSLD

SEQ ID NO: 876824 - protein, 158 aa, Homo sapiens; identical to SEQ ID NO: 876816

SEQ ID NO: 876825 - protein, 66 aa, Homo sapiens
LRQTQTISFRSEKIIRLIEKPGGYYSTPPDEEAEETRPLHHLVATSSCPNSGSCAPVWSKTLPVPF

SEQ ID NO: 876826 - protein, 158 aa, Homo sapiens; identical to SEQ ID NO: 876816

SEQ ID NO: 876827 - protein, 147 aa, Homo sapiens
QRSRDMAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKVGHTPYLTTPILGPHWLPPVRLPQV

SEQ ID NO: 876828 - protein, 116 aa, Homo sapiens; identical to SEQ ID NO: 876820

SEQ ID NO: 876829 - protein, 56 aa, Homo sapiens
IEYQGDPELQPIWSYEIASLVHTLFRLSSAINHRVGRRAGLASSERVLDAPAWGAV

SEQ ID NO: 876830 - protein, 81 aa, Homo sapiens
CSPERRAGLGLGAVQECSGLSRRHHSHRLLRTEAETGDQDGTVWLQEATQPQEAASKRPTSPAWGRAWLSSMWSFELYMFH

SEQ ID NO: 876831 - protein, 74 aa, Homo sapiens
AEEQKSAPTDTSRQQQAIEARRCRKFGRGSQRRVQPLDSLTPGEDRLPTPSPFWLPIHLAESNLHHTIKPCTDL

SEQ ID NO: 876832 - protein, 290 aa, Homo sapiens
VKAAPALIDPLYLMAQVRYYSELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEVRLG

SEQ ID NO: 876833 - protein, 354 aa, Homo sapiens
VKAAPALIDPLYLMAQVRYYSELENAQSILQRCLELDPASVDAHLLMCQIYLAQGNFGMCFHCLELGVSHNFQVRDHPLYHLIKARALNKAGDYPEAIKTLKMVIKLPALKKEEGRKFLRPSVQPSQRASILLELVEALRLNGELHEATKVMQDTINEFGGTPEENRITIANVDLVLSKGNVDVALNMLRNILPKQSCYMEAREKMANIYLQTLRDRRLYIRCYRELCEHLPGPHTSLLLGDALMSILEPEKALEVYDEAYRQNPHDASLASRIGHAYVKAHQYTEAIEYYEAAQKINGQDFLCCDLGKLLLKLKKVNKAEKVLKQALEHDIVQDIPSMMNDVKCLLLLAKVYK

SEQ ID NO: 876834 - protein, 149 aa, Homo sapiens
QNLSKAKCFISLQSRTGHFAFESWMAGSSKQVSTGVGRRRRTPPANQSAQRPPFPRRRPAPKFQTGYAPLPPSPSAELSEPELCEEKEVSVFPRTLRSGPLYCRPVFLSTLARPPSLYKWEESFEPAVLWWWRGRDRRRRDSGRARCGR

SEQ ID NO: 876835 - protein, 429 aa, Homo sapiens
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 876836 - protein, 112 aa, Homo sapiens [sequence omitted]

SEQ ID NO: 876837 - protein, 143 aa, Homo sapiens
IQWLPLRAPTGLGGRRFRRGFYWVSCCRRSMGSPKPRHLFLFVHVWLTHVHVFSPGGPQNQFRLKGETTPQCSPLLGWEGIVASEGIRCSSRTPGVIPPLGEVQVPRGRASIENSHQKTRGNLQMNWLLKTCLQGLQEVGYIG

SEQ ID NO: 876838 - protein, 150 aa, Homo sapiens
KTMLLMSAPRKVICVCLQPWPPFLPHRAAPWAPCFLTNTWSVPECSPVTLCLNDRHRSPECMRRPRGSTKRAAFPPGALAADTVRYCPPAGSLIGSQCKSLSFSLIQPQCASCNHYCLLLTSQPGSPLPSVPKSTFLRTSTIQLHPQQPL

SEQ ID NO: 876839 - protein, 118 aa, Homo sapiens
FSALKELRLEDNLLTHLPENLDSLVNLKVLTLMDNPMEEPPKEVCAEGNEAIWKYLKENRNRNIMATKIQAWWRGTMVQRGFGKFGELLKPQKKGKTSPKDKKGKKDVKGKPGKGKKK

SEQ ID NO: 876840 - protein, 1260 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876841 - protein, 118 aa, Homo sapiens
LDHRFMVVGDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876842 - protein, 1260 aa, Homo sapiens; identical to SEQ ID NO: 876840

SEQ ID NO: 876843 - protein, 1009 aa, Homo sapiens
MQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876844 - protein, 1260 aa, Homo sapiens; identical to SEQ ID NO: 876840

SEQ ID NO: 876845 - protein, 1075 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGEGLTTAASADLCHEAAHLPAPA

SEQ ID NO: 876846 - protein, 1288 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQVGLDGWVEGVGRVSDQCGAFTSALGFLQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876847 - protein, 1230 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKAKEEQQDDTVYMGKVTFSCAAGFGQRHRLVLTQEQLHQLHSRLIS

SEQ ID NO: 876848 - protein, 1260 aa, Homo sapiens; identical to SEQ ID NO: 876840

SEQ ID NO: 876849 - protein, 1260 aa, Homo sapiens; identical to SEQ ID NO: 876840

SEQ ID NO: 876850 - protein, 1260 aa, Homo sapiens; identical to SEQ ID NO: 876840

SEQ ID NO: 876851 - protein, 1075 aa, Homo sapiens; identical to SEQ ID NO: 876845

SEQ ID NO: 876852 - protein, 1230 aa, Homo sapiens; identical to SEQ ID NO: 876847

SEQ ID NO: 876853 - protein, 1204 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQPHMRRSLCPCRLCDPSGSSSALRKADEGKVAKSVGTVLTFSCAAGFGQRHRLVLTQEQLHQLHSRLIS

SEQ ID NO: 876854 - protein, 1137 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQMGTGGSEFKIQKKLTPFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 876855 - protein, 1018 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKSGTFPGALLPLILPLLELSAS

SEQ ID NO: 876856 - protein, 1137 aa, Homo sapiens; identical to SEQ ID NO: 876854

SEQ ID NO: 876857 - protein, 1137 aa, Homo sapiens; identical to SEQ ID NO: 876854

SEQ ID NO: 876858 - protein, 558 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAKWN

SEQ ID NO: 876859 - protein, 621 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKVWPINHMFHRNLVNLP

SEQ ID NO: 876860 - protein, 174 aa, Homo sapiens
MQTKSLGGRRQVTEPFPFPEVIKFKTKGGFGKPKFFVEHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 876861 - protein, 129 aa, Homo sapiens
MISSLHPHFLTPYRPFLQPPPVELRAAALRAEITDAEGLGLKLEDRETVIKELKKSLKIKGEELSEANVRLSLLEKKLDSAAKDADERIEKVQTRLEETQALLRKKEKSGTFPGALLPLILPLLELSAS

SEQ ID NO: 876862 - protein, 1260 aa, Homo sapiens; identical to SEQ ID NO: 876840

SEQ ID NO: 876863 - protein, 1314 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRDTNPANFCIFSRDGVSPCWPAWSRSRPHDPPALTSQSAGITGVNHRRWPTLPFFSPNYGVVSKEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876864 - protein, 866 aa, Homo sapiens
MVPPRLWDIVDPRPRLMSSNEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 876865 - protein, 1260 aa, Homo sapiens; identical to SEQ ID NO: 876840

SEQ ID NO: 876866 - protein, 1260 aa, Homo sapiens; identical to SEQ ID NO: 876840

SEQ ID NO: 876867 - protein, 1260 aa, Homo sapiens; identical to SEQ ID NO: 876840

SEQ ID NO: 876868 - protein, 1260 aa, Homo sapiens; identical to SEQ ID NO: 876840

SEQ ID NO: 876869 - protein, 1075 aa, Homo sapiens; identical to SEQ ID NO: 876845

SEQ ID NO: 876870 - protein, 1113 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASFCAYRDHLE

SEQ ID NO: 876871 - protein, 1137 aa, Homo sapiens; identical to SEQ ID NO: 876854

SEQ ID NO: 876872 - protein, 1137 aa, Homo sapiens; identical to SEQ ID NO: 876854

SEQ ID NO: 876873 - protein, 1137 aa, Homo sapiens; identical to SEQ ID NO: 876854

SEQ ID NO: 876874 - protein, 722 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQPPQPAPR

SEQ ID NO: 876875 - protein, 486 aa, Homo sapiens
GRRSSVGSELGAEPLTVQTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELFGLNREQNCVLSLADIKEKSSSRDC

SEQ ID NO: 876876 - protein, 102 aa, Homo sapiens
MEQVAQLKSLSDTVEKLKDEVLKETVSQRPGATVPTDFATFPSSAFLRAKEEQQDDTVYMGKVTFSCAAGFGQRHRLVLTQEQRYQTGNSHVYDERLRARIP

SEQ ID NO: 876877 - protein, 325 aa, Homo sapiens
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPEASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 876878 - protein, 68 aa, Homo sapiens
STKQFAFAGEGGIKGRVAKAGDGALGWDQRPMGWDDKCLGHIGSCEKLALMPVWGQIWGQEDSPAICD

SEQ ID NO: 876879 - protein, 107 aa, Homo sapiens
MCLWAGRTHRRRQQAQAPLVTRPTTDPELPVRRMHIYRLNTKEFSKKANDRSGGPELLPLIRIKEVYRCLGPGQFPGKSETSSQVCFVEDTAPLAQGCETSSQTSVK

SEQ ID NO: 876880 - protein, 107 aa, Homo sapiens
ELNVAGAFCTSLNTPGEDISGWVVSCSQTCIRASAAALGLRSGSAGAPEKPLAFLHRRAGRCRGEAACGSPRSSSFPEAAIREVLADLRGSGTVPMEFLFRSTPELS

SEQ ID NO: 876881 - protein, 165 aa, Homo sapiens
MCDQTFLVNVFGSCDKCFKQRALRPVFKKSQQLSYCSTCAEIMATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACG

SEQ ID NO: 876882 - protein, 353 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 876883 - protein, 353 aa, Homo sapiens; identical to SEQ ID NO: 876882

SEQ ID NO: 876884 - protein, 299 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRKTALALYEFPPMGLLSALDHGIIPSESGPNHLLTVHSCIPENLKSSHVNRYYF

SEQ ID NO: 876885 - protein, 299 aa, Homo sapiens; identical to SEQ ID NO: 876884

SEQ ID NO: 876886 - protein, 299 aa, Homo sapiens; identical to SEQ ID NO: 876884

SEQ ID NO: 876887 - protein, 283 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 876888 - protein, 126 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKVRHCSQPRYRGFRIPAYLKVLWSSCPALS

SEQ ID NO: 876889 - protein, 353 aa, Homo sapiens; identical to SEQ ID NO: 876882

SEQ ID NO: 876890 - protein, 353 aa, Homo sapiens; identical to SEQ ID NO: 876882

SEQ ID NO: 876891 - protein, 395 aa, Homo sapiens
MCDQTFLVNVFGSCDKCFKQRALRPVFKKSQQLSYCSTCAEIMATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 876892 - protein, 305 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 876893 - protein, 93 aa, Homo sapiens
IKGLSCKYSIFGFTFQLLAFNTTERAIVSNTAMITAMQISLQEPIFHSVGRSGIADHMPSVKVILKVWSLGQQHQHHLELVRNEDSQALLYTY

SEQ ID NO: 876894 - protein, 49 aa, Homo sapiens
RPLLAQAGQLGAGRGMGWPGQQVGSVILTGRTSSGSWGDGLGCDCGEFR

SEQ ID NO: 876895 - protein, 146 aa, Homo sapiens
MGRTRETGTEKNTSSLELEESLPEQPETGRQEEELPRFPCKKQDYSPSSGEAQEVPFALSLSSDGAVSPVGELAAGGDRDLESQAGSLVESKARDAAEEVAPPLPMGASVPSIDSMMRKLEEMGLNLRKDQKKTKKRVSFSEQLFT

SEQ ID NO: 876896 - protein, 135 aa, Homo sapiens
MTEVVPSSALSEVSLRLLCHDDIDTVKHLCGDWFPIEYPDSWYRDITSNKKFFSLAATYRGAIVGMIVAEIKNRTKIHKARGWRLFYHPNFSVDTTKSGTSLSLGVVKEVQEARNRFLLTLKGSTVTVLTTGPGH

SEQ ID NO: 876897 - protein, 90 aa, Homo sapiens
MTEVVPSSALSEVSLRLLCHDDIDTVKHLCGDWFPIEYPDSWYRDITSNKKFFSLAATYRGAIVGMIVAEIKNRTKIHKDGDILISATII

SEQ ID NO: 876898 - protein, 90 aa, Homo sapiens; identical to SEQ ID NO: 876897

SEQ ID NO: 876899 - protein, 140 aa, Homo sapiens
QVRGWVLNRPRVESAWWLPVEPGLSLVTRTRQLRDGPASSQVHSPVLARRISPFCASLDRLVLWSLFLPPAWILPRAGRPVAETRGTVLLTQLPLVTFAWLWYKIVGITEESPSLRVSTDAVTATCVLVKCPSSPPCVLR

SEQ ID NO: 876900 - protein, 110 aa, Homo sapiens
KTESHSETQATVPWHNLGSLQPPSSGSSNSPASASRVAEITGAHHHAWLIFVFLVETGFHHVGQAGLELLTSDDPPTSASQSAGIIGMSHHAQPTLAFEGNIFMFIGKKA

SEQ ID NO: 876901 - protein, 44 aa, Homo sapiens
MGMYPPLLLKIYLSRHISILFYLKILYKSGIIWLSWYSFILLVL

SEQ ID NO: 876902 - protein, 177 aa, Homo sapiens
LPLQTCQGPGELDPPRHTIAPEMAGDTEVWKQMFQELMREVKPWHRWTPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 876903 - protein, 254 aa, Homo sapiens
LPLQTCQGPGELDPPRHTIAPEMAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 876904 - protein, 34 aa, Homo sapiens [sequence omitted]

SEQ ID NO: 876905 - protein, 34 aa, Homo sapiens [sequence omitted]

SEQ ID NO: 876906 - protein, 119 aa, Homo sapiens
YPIGLAQVHNKSYQLIAKCYTFLARENKANFDNIKPSITLCIEFFFSKTESCSVTRLECSGTISAHCNLCPLGSSDSPASASQVAGTTGACHPNQLIFVFLVETGFHHVGQDGLNLLTL

SEQ ID NO: 876907 - protein, 38 aa, Homo sapiens
MYLSVTESDLNEENLASTVPDQTEAPSVMETASRSSGR

SEQ ID NO: 876908 - protein, 124 aa, Homo sapiens
CLLLMRDTSVSLTQNPEAYFSIPPHFLSPPMSPGACPSSWSLISCVILGESIYISGFHVPHPYKGGNGHPIPSIWYALNVHNMFPFTKFSPKFVSLPNPQIYTLKPNPQCDGIRKWGFGEVIRS

SEQ ID NO: 876909 - protein, 111 aa, Homo sapiens
HLVCSLLYMWLAEKGRWSRYFEHDWHNCQHLYLQLDFTGCSLLERNMIWGYFSLKGKLYRRLPYPHYLFYFLGLGPLRTSCGFMVPGIVSPDHESPVLECPLQKSVCFASS

SEQ ID NO: 876910 - protein, 80 aa, Homo sapiens
AVMSGGVGGGLGSTCGLGSGKGSPGSCCTSIVTGGSNIILGSGKDPVLDSCSVSGSSAGSSCHTILKKTVESSLKTSITY

SEQ ID NO: 876911 - protein, 347 aa, Homo sapiens
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEEELEDLDAVHREEKISLEELRRRHKVLVGEFAQIREEREINSKKRMEAEQEMVRMVRAATLIQALWKGYLVRSLLRSKKKRGKGKAKDKEKGKQKGKEKGKGKK

SEQ ID NO: 876912 - protein, 252 aa, Homo sapiens
MALDILAMAPLYQAPAINRIGPKTDPSKRPADPLKPLVLSRTKLTTIEAKRIMSILDEAIYKVELVTLLSYVASNREDMEGMLGEDVMRAVREHEDLCQVLLENVRCLKEKERQLQEQKEAEEEGWLRDRLLSIELQKSSLSPLMQQIKDSTKNVLRLLLSNPQAARLLQMQTQGRSAEAQNFIDSLIELRGFLFEKLLTSPMEARDKAQFLQDISRQNSNNQQIIDTLEKELAERMKNRNAEVEKENFVIQ

SEQ ID NO: 876913 - protein, 252 aa, Homo sapiens; identical to SEQ ID NO: 876912

SEQ ID NO: 876914 - protein, 347 aa, Homo sapiens; identical to SEQ ID NO: 876911

SEQ ID NO: 876915 - protein, 116 aa, Homo sapiens
LEVAERGGQHSSSQQLPHCSQSWAQWKLWRQRPGFAIWAPLPHWRGTSPIQQSSSPAAEGPAATAAGAVCLPAGGAGEQEKEPVSRGSSRSSCSQRRPPPPGMEVCPQLGIWAICP

SEQ ID NO: 876916 - protein, 84 aa, Homo sapiens
SLQLALRRLGRSCKELPLRQRGVLAGLEMLPPLTLGPRLRSPREVQPSNTETRCLQSSRGPRCSPIAGTRNGDTSDGLFLAGVS

SEQ ID NO: 876917 - protein, 79 aa, Homo sapiens
LGRGEKLLPVENHLSRERLQQIQMFWQRWEPGSSDSEDCWSPQGKSALWWPESVPAVERSSEPRPRLGAEPTADSEVKG

SEQ ID NO: 876918 - protein, 173 aa, Homo sapiens
SYCLVQLGGEDRLSSRVTRKGPQAETQGRYTEAANCDPCGALSWPVCGHYRPLVLGVFRQSSVSLEDGIIPTPSSLIKNYASPVFFPQMTPEREFGVWGPVCPRLALHNSVVSLSGGHTMGGLLAIGISDLFSRDNLCPKQLCSAQGAGVRGYQSCSPLCRPSVSYIRNLQTI

SEQ ID NO: 876919 - protein, 46 aa, Homo sapiens
VLWYLEKGLVVTGPPALVKQTKSFQNNPISIFYGDTRLINQKTIID

SEQ ID NO: 876920 - protein, 226 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGPELESPGAQG

SEQ ID NO: 876921 - protein, 319 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 876922 - protein, 241 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGKSTPWMGGNHSPRGLPLICCVALGT

SEQ ID NO: 876923 - protein, 113 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAEQMPSCVLRRSPAEKSLWTFTVCDLY

SEQ ID NO: 876924 - protein, 319 aa, Homo sapiens; identical to SEQ ID NO: 876921

SEQ ID NO: 876925 - protein, 184 aa, Homo sapiens
MQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 876926 - protein, 226 aa, Homo sapiens; identical to SEQ ID NO: 876920

SEQ ID NO: 876927 - protein, 266 aa, Homo sapiens
MGRAVATAAIPLGTSVASWSRPCSTSSRWTRISSGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 876928 - protein, 254 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGGSRGLVHGRLWRQDGVLAVTCAQEGVIRVKPQVSESKL

SEQ ID NO: 876929 - protein, 132 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAEQMPSCVLRRSPAEKSLWTFTGTRSCQYCTKWSGHEQGRASRCAL

SEQ ID NO: 876930 - protein, 163 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLR

SEQ ID NO: 876931 - protein, 319 aa, Homo sapiens; identical to SEQ ID NO: 876921

SEQ ID NO: 876932 - protein, 110 aa, Homo sapiens
MHCCVAAYISDYAFLGTALLPHQWQHKVHFMVSLDHSMWFHAPFRADHWMLYECESPWAGECGAVWDKGTDLEWQEPAFLGDADFPTSCVALHRSLPFLPSQALASSSSK

SEQ ID NO: 876933 - protein, 240 aa, Homo sapiens
MIPPPVPFGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 876934 - protein, 340 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAEQMPSCVLRRSPAEKEFVDLYRDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 876935 - protein, 226 aa, Homo sapiens; identical to SEQ ID NO: 876920

SEQ ID NO: 876936 - protein, 147 aa, Homo sapiens
MIPPPVPFGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGPELESPGAQG

SEQ ID NO: 876937 - protein, 91 aa, Homo sapiens
GSALIPQPVEKERRRCAVFRGGVSSGPCRKKEPRPGSLFCPFLTPHSVTKRWKQKDTYNVVQPPDFTYEGIVPRKLNNLPDVIMYLLSERI

SEQ ID NO: 876938 - protein, 653 aa, Homo sapiens
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 876939 - protein, 653 aa, Homo sapiens; identical to SEQ ID NO: 876938

SEQ ID NO: 876940 - protein, 73 aa, Homo sapiens
NDTELIRYVTITNCSPLVVKFRWFFLVNDEENQIRYPQHRTLTELCFSFVFSFRLFMGFSVFHVLAIHEYFPF

SEQ ID NO: 876941 - protein, 73 aa, Homo sapiens; identical to SEQ ID NO: 876940

SEQ ID NO: 876942 - protein, 72 aa, Homo sapiens
KDTAPVLEGLKEEEMTKEEISILSNACSKLQEQKKSLTRKKEELELWQGRFSPAVFLVYRSSFLTFYFPPIL

SEQ ID NO: 876943 - protein, 72 aa, Homo sapiens; identical to SEQ ID NO: 876942

SEQ ID NO: 876944 - protein, 101 aa, Homo sapiens
EQSRNPRSVPPGDRWEHMGFTKKGKPPRASPSESLRSFSIRTETHWALRRWILKTQSCGSRRWWPGRPRVKEGFLPVPSPGPLLTEGSSSQAGQKGPAMPL

SEQ ID NO: 876945 - protein, 76 aa, Homo sapiens
QGAAREQAPVNMHFASFSLYRVADEPLANASHKTGPELTWEVTPRMWIQGGMTKSEAITSTISAKKRGFLLFIIST

SEQ ID NO: 876946 - protein, 110 aa, Homo sapiens
TPSPSDPGVQAPAPPPSDPGVQTPNPFSLRPRSPGPSPSSLRPRSPGPQPLHPQIFKWNLGPGTVAHACNSKALGGQVGKTEPRKLRLQGAVIVPQQSSLGDRPRSCLKK

SEQ ID NO: 876947 - protein, 63 aa, Homo sapiens
MDSLSLFQLTNFSLVPVQWRTAYAGVCGFLWATFICFSQQSGDGTFKSAFTILYTKGTSATEG

SEQ ID NO: 876948 - protein, 288 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSEFGLCTGEYWGNARSPPEMWVLSGLGGRLFLGAPELSGFSPPRGDLFGKKGALVAGLFRASSR

SEQ ID NO: 876949 - protein, 260 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 876950 - protein, 260 aa, Homo sapiens; identical to SEQ ID NO: 876949

SEQ ID NO: 876951 - protein, 260 aa, Homo sapiens; identical to SEQ ID NO: 876949

SEQ ID NO: 876952 - protein, 260 aa, Homo sapiens; identical to SEQ ID NO: 876949

SEQ ID NO: 876953 - protein, 156 aa, Homo sapiens
MIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 876954 - protein, 151 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGREWLLKCALLEMALQENHLNMKDSSGQWACVSRKPM

SEQ ID NO: 876955 - protein, 157 aa, Homo sapiens
IPWPRPPEVPGVQMESRSLSAQCQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 876956 - protein, 193 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMRRGFTVLARMVSISVIRPP

SEQ ID NO: 876957 - protein, 260 aa, Homo sapiens; identical to SEQ ID NO: 876949

SEQ ID NO: 876958 - protein, 241 aa, Homo sapiens
LEDTRRDEMKMNEPAAMKAAALHLPQRMRTMRMTKMMRMTMTMRKMTLKYKALSSTLYTSVSPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 876959 - protein, 166 aa, Homo sapiens
MCRERTRAKYFHMLTERQRGGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 876960 - protein, 246 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSEFVTQSKYWGNMPGTHLKWRC

SEQ ID NO: 876961 - protein, 184 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMQFENLSRTVL

SEQ ID NO: 876962 - protein, 358 aa, Homo sapiens
SLPGLPSTLSRSESWDHMGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKISSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 876963 - protein, 302 aa, Homo sapiens
PSLGRGLGVALPVFWEGRMAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 876964 - protein, 311 aa, Homo sapiens
RRGSGKSRTRNPGHRSKISLPVFWEGRMAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 876965 - protein, 173 aa, Homo sapiens
MVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 876966 - protein, 269 aa, Homo sapiens
PSLGRGLGVALPVFWEGRMAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 876967 - protein, 311 aa, Homo sapiens; identical to SEQ ID NO: 876964

SEQ ID NO: 876968 - protein, 144 aa, Homo sapiens
MPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVRGDSTVHLRAGVTALPLPGRPARGVFYRQKQCWKIISNQGFIFTGP

SEQ ID NO: 876969 - protein, 106 aa, Homo sapiens
MPAVLERLSRYNSTSQAFAEVLRLPKQQLRKLLYPLQEVERFLAPYGRQDLHLRIFDPSPEDIARADNIFTATERNRIDYVSSAVRIDHAPDLPRPELEENIFISG

SEQ ID NO: 876970 - protein, 172 aa, Homo sapiens
PSLGRGLGVALPVFWEGRMAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPLEENIFISG

SEQ ID NO: 876971 - protein, 187 aa, Homo sapiens
MLHLRIFDPSPEDIARADNIFTATERNRIDYVSSAVRIDHAPDLPRPEGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 876972 - protein, 1053 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 876973 - protein, 103 aa, Homo sapiens
VADYSVATSKLGSLEAQDPYLITINRSHGRSAFTQAMFEVGTALWQRQNVGTLLWHETLITQAPKGVLYRPVFICSGFLDQQKWSIPGGLTRYTIPLFRGEKD

SEQ ID NO: 876974 - protein, 300 aa, Homo sapiens [sequence omitted]

SEQ ID NO: 876975 - protein, 738 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGNEKFILT

SEQ ID NO: 876976 - protein, 563 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVALKLVLEDHCFLVPACLLLRC

SEQ ID NO: 876977 - protein, 106 aa, Homo sapiens [sequence omitted]

SEQ ID NO: 876978 - protein, 919 aa, Homo sapiens
MLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 876979 - protein, 884 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEEQS

SEQ ID NO: 876980 - protein, 112 aa, Homo sapiens
GILKQVKDYIKQCSKCQEKLDRSRPISDVSEMLEELGLDLESGEESNESEDDLSNFTSSPTTASKPAKKKPVSKHELVFVSGTLQSALRFVTSVLVFAALVTYFSQTTKTAY

SEQ ID NO: 876981 - protein, 456 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRDCHRAYCGDGHRHEGVEDCDGSDFGYLTCETYLPGSYGDLQCTQYCYIDSTPCRYFT

SEQ ID NO: 876982 - protein, 137 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKVWSALF

SEQ ID NO: 876983 - protein, 66 aa, Homo sapiens
KLDEDASPNEETGDVPKDTLDDLFPIATIWPNNRLQWLFLFWNVADPGRGLGLEHCLDTHRPAGLF

SEQ ID NO: 876984 - protein, 921 aa, Homo sapiens
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFLEKANTRKDKTKTHFPIDTGMPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 876985 - protein, 408 aa, Homo sapiens
MPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 876986 - protein, 35 aa, Homo sapiens
MQVSCPTDQCCFHYPHLPHSEQQLVAAVIDYRQSR

SEQ ID NO: 876987 - protein, 65 aa, Homo sapiens
MGKKKMSLVRDKLNLRWQVEIYRGYLGMSLVSERGMQSHPRKDSWSSENSERAPGECGDVGEEER

SEQ ID NO: 876988 - protein, 181 aa, Homo sapiens
SLGPPLQLFSRATAEKSLSRSQEGLPWLPADSSGPRRSPGILACSPQPSNTRSSRGPDSDIGRVRPLGPAQAPGLKDQRGGCPLVARFGMAGVLKWKDMGKGPTERVPWSRRLAPQDAGLGTPGRRGDPGSRSEVQALPSRVPYWAAQGRECSGFRGGHGIIGRYKKPGLPDRSPPPPCPF

SEQ ID NO: 876989 - protein, 408 aa, Homo sapiens
PGRAAGPAHPGGRNPLRPARPAAMSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 876990 - protein, 408 aa, Homo sapiens; identical to SEQ ID NO: 876989

SEQ ID NO: 876991 - protein, 131 aa, Homo sapiens
PGRAAGPAHPGGRNPLRPARPAAMSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGNL

SEQ ID NO: 876992 - protein, 383 aa, Homo sapiens
PGRAAGPAHPGGRNPLRPARPAAMSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKVSQAAADLKQFCLQNAQHDPLLTGVSSSTNPFRPQKVCSFL

SEQ ID NO: 876993 - protein, 408 aa, Homo sapiens; identical to SEQ ID NO: 876989

SEQ ID NO: 876994 - protein, 179 aa, Homo sapiens
MSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 876995 - protein, 142 aa, Homo sapiens
LEVTGYNRGREITTLKKKEAIFRVIQQIKEKGFNSGDKGFMTVFVRDVAGRATRAIIEDSTRRPAGFFKGVGKGLVGAVARPTGGIIDMASSTFQGIKRATETSEVESLRPPRFFNEDGVIRPYRLRDGTGNQMLQASKSLI

SEQ ID NO: 876996 - protein, 3201 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEVESIQNVLVMLPTICKCPAAFGGQPSRFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 876997 - protein, 3201 aa, Homo sapiens; identical to SEQ ID NO: 876996

SEQ ID NO: 876998 - protein, 319 aa, Homo sapiens [sequence omitted]

SEQ ID NO: 876999 - protein, 3096 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEVESIQNVLVMLPTICKCPAAFGGQPSRFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQASKSLI

SEQ ID NO: 877000 - protein, 3174 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 877001 - protein, 147 aa, Homo sapiens [sequence omitted]

SEQ ID NO: 877002 - protein, 3095 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQKIQFYREWIMTHSSSSDDDDDDDDDDESDLNH

SEQ ID NO: 877003 - protein, 3194 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEVESIQNVLVMLPTICKCPAAFGGQPSRFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARVNIINLLFK

SEQ ID NO: 877004 - protein, 186 aa, Homo sapiens [sequence omitted]

SEQ ID NO: 877005 - protein, 108 aa, Homo sapiens
SWRRSAALRSPRAPAGWARDAGLGLSPRDLEHPRDHPEASGGHSADEEADAWVQNPGPPDSEPRSSRASAQTCARSKSPPSQHSSETRGVPTVPASSAGYIVGQPLKK

SEQ ID NO: 877006 - protein, 136 aa, Homo sapiens [sequence omitted]

SEQ ID NO: 877007 - protein, 255 aa, Homo sapiens
NEHVLSAGFDINTPDNLGRTCLHAAASGGNVECLNLLLSSGADLRRRDKFGRTPLHYAAANGSYQCAVTLVTAGAGVNEADCKGCSPLHYAAASDTYRRAEPHTPSSHDAEEDEPLKESRRKEAFFCLEFLLDNGADPSLRDRQGYTAVHYAAAYGNRQNLELLLEMSFNCLEDVESTIPVSPLHLAAYNGHCEALKTLAETLVNLDVRDHKGRTALFLATERGSTECVEVLTAHGASALIKERKRKWTPLHAAG

SEQ ID NO: 877008 - protein, 84 aa, Homo sapiens
IRSSKSAEDLTDGSYDDVLNAEQLQKLLYLLESTEDPVIIERALITLGNNAAFSVNQAIIRELGGIPIVANKINHSNQSIKDKA

SEQ ID NO: 877009 - protein, 76 aa, Homo sapiens
MESHGKSCLKAAAAKLRDSSFRGFYECIYESLRDTQGPGAGSKALHLSSCSESQVNVIEHSSTGPGQQQSSKEAMG

SEQ ID NO: 877010 - protein, 274 aa, Homo sapiens
RLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGLSKVVMLLELNYSTRN

SEQ ID NO: 877011 - protein, 274 aa, Homo sapiens; identical to SEQ ID NO: 877010

SEQ ID NO: 877012 - protein, 274 aa, Homo sapiens; identical to SEQ ID NO: 877010

SEQ ID NO: 877013 - protein, 274 aa, Homo sapiens; identical to SEQ ID NO: 877010

SEQ ID NO: 877014 - protein, 274 aa, Homo sapiens; identical to SEQ ID NO: 877010

SEQ ID NO: 877015 - protein, 103 aa, Homo sapiens
MGGSERDLRRRAGVASRFHVPGGLKRGPLPGRGRAGRVPSGGFVPGPSPLGRGLVGYRGTLARGRARLPRPSPGLLRPRREAQEVAAAGVRLGRTAVPSAGTL

SEQ ID NO: 877016 - protein, 202 aa, Homo sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGLSKVVMLLELNYSTRN

SEQ ID NO: 877017 - protein, 274 aa, Homo sapiens; identical to SEQ ID NO: 877010

SEQ ID NO: 877018 - protein, 172 aa, Homo sapiens
MLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTEIC

SEQ ID NO: 877019 - protein, 103 aa, Homo sapiens; identical to SEQ ID NO: 877015

SEQ ID NO: 877020 - protein, 256 aa, Homo sapiens
RLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLADTML

SEQ ID NO: 877021 - protein, 274 aa, Homo sapiens
MLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAAQYYKERFTIMTLQSWETYHKI

SEQ ID NO: 877022 - protein, 233 aa, Homo sapiens
MLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTCEYFDFTRTVGGTKIILFVSFWTMFLE

SEQ ID NO: 877023 - protein, 189 aa, Homo sapiens
MLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTGISLILTSVFFTWLIIDKTT

SEQ ID NO: 877024 - protein, 274 aa, Homo sapiens; identical to SEQ ID NO: 877010

SEQ ID NO: 877025 - protein, 274 aa, Homo sapiens; identical to SEQ ID NO: 877010

SEQ ID NO: 877026 - protein, 274 aa, Homo sapiens; identical to SEQ ID NO: 877010

SEQ ID NO: 877027 - protein, 202 aa, Homo sapiens; identical to SEQ ID NO: 877016

SEQ ID NO: 877028 - protein, 217 aa, Homo sapiens
EHRVIHCRGCLKCQRGSVVYATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGLSKVVMLLELNYSTRN

SEQ ID NO: 877029 - protein, 331 aa, Homo sapiens
RLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGRFCHHTYLLASSCLFRDQRVINLKCSRINCPVTLPEKLFTVLLSSHVLFCFLNFPPSLCTLGLSKVVMLLELNYSTRN

SEQ ID NO: 877030 - protein, 274 aa, Homo sapiens; identical to SEQ ID NO: 877010

SEQ ID NO: 877031 - protein, 263 aa, Homo sapiens
MLGTRLGLIRPRLGPGRGPARSGGGRRRGSYGGGGLCREVRQRRRGESRVLWSELEGEAGGAGGWASSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGDKGEHASSWS

SEQ ID NO: 877032 - protein, 103 aa, Homo sapiens; identical to SEQ ID NO: 877015

SEQ ID NO: 877033 - protein, 644 aa, Homo sapiens
VFCPSADTVCQPKLCLRAHRLHRVPNSFFPRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 877034 - protein, 650 aa, Homo sapiens
VFCPSADTVCQPKLCLRAHRLHRVPNSFFPRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVFFNSGIRYWLKLPLSLTQFY

SEQ ID NO: 877035 - protein, 651 aa, Homo sapiens
VFCPSADTVCQPKLCLRAHRLHRVPNSFFPRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 877036 - protein, 623 aa, Homo sapiens
VFCPSADTVCQPKLCLRAHRLHRVPNSFFPRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASSFEGWKTKITMPV

SEQ ID NO: 877037 - protein, 316 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 877038 - protein, 216 aa, Homo sapiens
MPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKVPWIPLDPLAPDLARYPSYSQAQALRCTVRAGEMLYLPALWFHHVQQSQGCIAVNFWYDMEYDLKYSYFQLLDSLTKASGLD

SEQ ID NO: 877039 - protein, 1360 aa, Homo sapiens
MFLMGAVVFSRGREEEFIDHKTRVAGRSQGRRRLGDEGSVLSVFCPGNGLLAELPGTTDLGPGDSEAPSCRPEALEASGSSMLLCLSCLECEGPGLTLVDEALQHCPGPGCSLDLTCLGSLWRQVEGRKEAVGTGFPGPGAPARLHSQNQGHGFGGSYRGTIFSLTWQDLEDMTACEGSELGAASPAQERAHFQDALLTRVEGGYESSSAWGPRPCCATSPPSIAYVPCHPRPAGKLLSWGVGWGCGVESLKDTSPRRWKQVCVRHEIWSQPARAPTPIVDLRQVTASLCLSFLVEWAIVNSICAEGGCAINELMYAKPLAQSRRRALCKVLAGVMMEISCLLLLIQDSDEMEDGPGVQDKALRHCSSLLCGPCHPWLHRPVAGLPSPTLQAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGGEWPKSWDLCPCSWWNKGRTRTVCRLQMSHPPLLSQVPCFLETGTLPGSLSPLGRRQGPEVLCTKPRPQGLGLLVLSCPKAKPWVGVGVWVPKGSATMRLRRGLLTEWCEFSPYEVGFPKYGAFIPSELFGSEFFMGQLMKRLPESRICFLEGIWSNLYAANLQDSLYWASEPSQFWDRWVRNQANLGKCSGPFIRVPRGSQLGLHQGAGGSHLFPLQGHHQGGDKGAGVPISPTLPVYDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877040 - protein, 739 aa, Homo sapiens
MELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877041 - protein, 1202 aa, Homo sapiens
MFLMGAVVFSRGREEEFIDHKTRVAGRSQGRRRLGDEGSVLSVFCPGNGLLAELPGTTDLGPGDSEAPSCRPEALEASGSSMLLCLSCLECEGPGLTLVDEALQHCPGPGCSLDLTCLGSLWRQVEGRKEAVGTGFPGPGAPARLHSQNQGHGFGGSYRGTIFSLTWQDLEDMTACEGSELGAASPAQERAQFPGCSSDQGGGRVREQLSLGPKALMCYFPSLDSLCPLPPKTSRKAACWGVGWGCGVESLKDTSPRRWKQVCVRHEIWSQPARAPTPIVDLRQVTASLCLSFLVEWAIVNSICAEGGCAINELMYAKPLAQSRRRALCKVLAGVMMEISCLLLLIQDSDEMEDGPGVQDKALRHCSSLLCGPCHPWLHRPVAGLPSPTLQAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877042 - protein, 739 aa, Homo sapiens; identical to SEQ ID NO: 877040

SEQ ID NO: 877043 - protein, 739 aa, Homo sapiens; identical to SEQ ID NO: 877040

SEQ ID NO: 877044 - protein, 305 aa, Homo sapiens
WPWGRVGWDKSRGPSSLTAALSGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877045 - protein, 76 aa, Homo sapiens
FDSSCHLFAACLHAIEGSQHHEGLDLLYPLPGREGLWQPLSSLQWGKEAKPICVITQNPPACACFPFCATLSSWST

SEQ ID NO: 877046 - protein, 73 aa, Homo sapiens
PHLCLLDVGYLINTSCLPLLQPTRDVDLILSLDYNLHGAFQVGKGGQPTREAVGGPCPLKRGALESSVWFSFL

SEQ ID NO: 877047 - protein, 1012 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877048 - protein, 1202 aa, Homo sapiens
MFLMGAVVFSRGREEEFIDHKTRVAGRSQGRRRLGDEGSVLSVFCPGNGLLAELPGTTDLGPGDSEAPSCRPEALEASGSSMLLCLSCLECEGPGLTLVDEALQHCPGPGCSLDLTCLGSLWRQVEGRKEAVGTGFPGPGAPARLHSQNQGHGFGGSYRGTIFSLTWQDLEDMTACEGSELGAASPAQERAHFQDALLTRVEGGYESSSAWGPRPCCATSPPSIAYVPCHPRPAGKLLSWGVGWGCGVESLKDTSPRRWKQVCVRHEIWSQPARAPTPIVDLRQVTASLCLSFLVEWAIVNSICAEGGCAINELMYAKPLAQSRRRALCKVLAGVMMEISCLLLLIQDSDEMEDGPGVQDKALRHCSSLLCGPCHPWLHRPVAGLPSPTLQAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877049 - protein, 1202 aa, Homo sapiens
MFLMGAVVFSRGREEEFIDHKTRVAGRSQGRRRLGDEGSVLSVFCPGNGLLAELPGTTDLGPGDSEAPSCRPEALEASGSSMLLCLSCLECEGPGLTLVDEALQHCPGPGCSLDLTCLGSLWRQVEGRKEAVGTGFPGPGAPARLHSQNQGHGFGGSYRGTIFSLTWQDLEDMTACEGSELGAASPAQERAQFPGCSSDQGGGRVREQLSLGPKALMCYFPSLDSLCPLPPKTSRKAACWGVGWGCGVESLKDTSPRRWKQVCVRHKIWSQPARAPTPIVDLRQVTASLCLSFLVEWAIVNSICAEGGCAINELMYAKPLAQSRRRALCKVLAGVMMEISCLLLLIQDSDEMEDGPGVQDKALRHCSSLLCGPCHPWLHRPVAGLPSPTLQAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877050 - protein, 739 aa, Homo sapiens; identical to SEQ ID NO: 877040

SEQ ID NO: 877051 - protein, 1081 aa, Homo sapiens
MFLMGAVVFSRGREEEFIDHKTRVAGRSQGRRRLGDEGSVLSVFCPGNGLLAELPGTTDLGPGDSEAPSCRPEALEASGSSMLLCLSCLECEGPGLTLVDEALQHCPGPGCSLDLTCLGSLWRQVEGRKEAVGTGFPGPGAPARLHSQNQGHGFGGSYRGTIFSLTWQDLEDMTACEGSELGAASPAQERAHFQDALLTRVEGGYESSSAWGPRPCCATSPPSIAYVPCHPRPAGKLLSWGVGWGCGVESLKDTSPRRWKQVCVRHEIWSQPARAPTPIVDLRQVTASLCLSFLVEWAIVNSICAEGGCAINELMYAKPLAQSRRRALCKVLAGVMMEISCLLLLIQDSDEMEDGPGVQDKALRHCSSLLCGPCHPWLHRPVAGLPSPTLQAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLECNGVILAHCNLRLWGSSDSPASASRVSWDYRLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCHP

SEQ ID NO: 877052 - protein, 265 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 877053 - protein, 136 aa, Homo sapiens
WGAAPWHLMCSQVPWIPLDPLAPDLARYPSYSQAQALRCTVRAGEMLYLPALWFHHVQQSQGCIAGEELPRPPGEEPCQGPAGPLGGGLGGSRSEEGSSCSDPRSSHMNFWYDMEYDLKYSYFQLLDSLTKASGLD

SEQ ID NO: 877054 - protein, 155 aa, Homo sapiens
MTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 877055 - protein, 186 aa, Homo sapiens
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 877056 - protein, 125 aa, Homo sapiens
AAGTRDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 877057 - protein, 125 aa, Homo sapiens; identical to SEQ ID NO: 877056

SEQ ID NO: 877058 - protein, 130 aa, Homo sapiens [sequence omitted]

SEQ ID NO: 877059 - protein, 186 aa, Homo sapiens; identical to SEQ ID NO: 877055

SEQ ID NO: 877060 - protein, 186 aa, Homo sapiens; identical to SEQ ID NO: 877055

SEQ ID NO: 877061 - protein, 164 aa, Homo sapiens
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVVSIREVLP

SEQ ID NO: 877062 - protein, 186 aa, Homo sapiens; identical to SEQ ID NO: 877055

SEQ ID NO: 877063 - protein, 186 aa, Homo sapiens; identical to SEQ ID NO: 877055

SEQ ID NO: 877064 - protein, 155 aa, Homo sapiens; identical to SEQ ID NO: 877054

SEQ ID NO: 877065 - protein, 74 aa, Homo sapiens
AAAYYYYCSNSSFYRCTGTCAGWGTCTLSTSLWDQSSILTIICTWNEAVIPPKNQSGWFTMRSEEASWAFGSSN

SEQ ID NO: 877066 - protein, 186 aa, Homo sapiens; identical to SEQ ID NO: 877055

SEQ ID NO: 877067 - protein, 186 aa, Homo sapiens; identical to SEQ ID NO: 877055

SEQ ID NO: 877068 - protein, 119 aa, Homo sapiens
MTGSLRHRWVLGDRGWSFNSVLDPDGEERGFSSAHTEAHSACGGKRLTSAPSFKQAELSGLVVWVGLSPPRKLRVVNTCFSSAVSRVAWGVKASGSRTGSGPSRLTFSSLWGALASLVA

SEQ ID NO: 877069 - protein, 108 aa, Homo sapiens [sequence omitted]

SEQ ID NO: 877070 - protein, 231 aa, Homo sapiens [sequence omitted]

SEQ ID NO: 877071 - protein, 236 aa, Homo sapiens
GDDRVFFFNPTMHLSVWEKPMDLKDRGDLNRIIEDPPHKRKLEAPATDNSDGSSSEDNREDQDVKTKRNRTEGCGSPKPEEAKREDKGTRTPPPQILLPLEERVTHFRDMLLERGVSAFSTWEKELHKIVFDPRYLLLNSEERKQIFEQFVKTRIKEEYKEKKSKLLLAKEEFKKLLEESKVSPRTTFKEFAEKYGRDQRFRLVQKRKDQEHFFNQFILILKKRDKENRLRLRKMR

SEQ ID NO: 877072 - protein, 236 aa, Homo sapiens; identical to SEQ ID NO: 877071

SEQ ID NO: 877073 - protein, 178 aa, Homo sapiens
TTDHTPATQPSQASHLVAFLRVHLLCLGPVHTCSMSLRPYCHLPHLDILHFLPELPANALCQVSAFRPHLLLPFCSHIPLIPTAGREIMPEPNISSQLPLALFSLSGVGKQIRSNLCQDSRNCGTIFFSLVQTGGWNYGGKMYNIFLSEIGTEHNTLVDSSVMLVNGIEYNSKERQWL

SEQ ID NO: 877074 - protein, 576 aa, Homo sapiens
FLSHKQDIPVLNHHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGKTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 877075 - protein, 525 aa, Homo sapiens
MPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGKTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 877076 - protein, 121 aa, Homo sapiens
QIIPMIPGGKMDAQSGQSTHPGIPQADGSGKNRVKPRLLTLMLVRARYPPPPALVIWPPSPAAQGRVSWKAQAVWREGRLLVLSFCLLSPVCAWKLRREFLQGGLPRPGPAFSPRSDPASR

SEQ ID NO: 877077 - protein, 127 aa, Homo sapiens
FLRSGFSNCISAAGVSSSVRNRSGNSMNQREEAAALAKLGPGPHGCPDPRQHCQPLTVLGAGFIPRRLCLPSLQSRAHLQVGSVNVPRHRAHPWMPPEFTDSTATPEPWAPALPIGSPQNALHLRGW

SEQ ID NO: 877078 - protein, 134 aa, Homo sapiens
RRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 877079 - protein, 1550 aa, Homo sapiens
SRGVWRLSERRTQEAQGAGGDPQAARTPRKGVSPADSCAAPRAGLLLGGSACTQAAAQRQLLHAELKLVLQQKGERTQEPGVQVPPSNAMEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKMPSFGLARGKEAEVQGDRASPGEKAESTAVQLKIPEVELVTLGAQEEGRAEGAVAVSGMQLSGLKVSTARQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 877080 - protein, 1767 aa, Homo sapiens
SRGVWRLSERRTQEAQGAGGDPQAARTPRKGVSPADSCAAPRAGLLLGGSACTQAAAQRQLLHAELKLVLQQKGERTQEPGVQVPPSNAMEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLVRVLSPAPALDCPSDPGLCAVSPIPRHRGPALPSVLSLTQANSTLCPFLSAPELFPGKGDRPTPAQGPHPPRRGVPTIGSRLARGPEPGYFEPGKPDSSLSAGPITAEWPWTKLFLSLGLSFPISRMRMLGKIPDQDLEVLGPRPYTPVDSFGDPRWLPAFLGTHGEMTGKKWGGCLGNKILDPAHPPPGPIPGGALPVHSQPPTVPPPPASLLSPQNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKMPSFGLARGKEAEVQGDRASPGEKAESTAVQLKIPEVELVTLGAQEEGRAEGAVAVSGMQLSGLKVSTARQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 877081 - protein, 1408 aa, Homo sapiens
MAGSGRGPALEPQRDTSPPSEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKVSTARQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 877082 - protein, 1032 aa, Homo sapiens
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 877083 - protein, 1079 aa, Homo sapiens
GDPLESVVFIYSMPGYKCSIKERMLYSSCKSRLLDSVEQDFHLEIAKKGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 877084 - protein, 1017 aa, Homo sapiens
MAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 877085 - protein, 1053 aa, Homo sapiens [sequence omitted]

SEQ ID NO: 877086 - protein, 120 aa, Homo sapiens
GDPLESVVFIYSMPGYKCSIKERMLYSSCKSRLLDSVEQDFHLEIAKKGFCRSALHPLSLLVQAIMLAMTLALGTLPAFLPCELQPHGLVNCNWLFLKSKEKSADASKESETKSEVNDKQ

SEQ ID NO: 877087 - protein, 109 aa, Homo sapiens
MLREEAAQKRKGKEPGMALPQGRLTFRDVAIEFSLAEWKCLNPSQRALYREVMLENYRNLEAVGRVSLHLKQTKNNKKRPQKCFSSRIMDFLLFLSGSSSFLSLFFIYL

SEQ ID NO: 877088 - protein, 117 aa, Homo sapiens
PASGPSGALGYVKAAVPSWPMGGAESSWLACDMFLTYCVVNEAGTGGAEQGPSLALQLPDLAAIQRDPAKCYFLNTLSFHNNLTTLLSFTSALKTRELDSFWLIYTDYIWKPSETEL

SEQ ID NO: 877089 - protein, 72 aa, Homo sapiens
MREPPEGLNDAPILTGPQLTLKNAHLRSLPEHSGSTDNSYACTKEHDFKRLWPNCLLQAESLHAKVGLNEVC

SEQ ID NO: 877090 - protein, 91 aa, Homo sapiens
PLGTHFQSSWDYRFETSIIFCGEEKSSDFSGEKKVGRKSLQVQQHSKRTEIIPPFLKLSKEKVTRKENSLCKLPNQYSVHKTSSPLCTSSA

SEQ ID NO: 877091 - protein, 298 aa, Homo sapiens
AGSGSQASPLCATCGPALLRAPTRAAMTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKKQKTQQKKKLFGGARAPRKNFLNPILVGGRGPRVRGPWAKPGFHKKNRATDTLGRWASSPNKKRGGEHERVRKQTPEGGRGGTTGPIQKGSRGAPNNKSRRPAMITQSTRKGQQRTHAPAAERTKTDKSRRTTRNADDNDRHQNTTNTRNRHCTTHEYTHD

SEQ ID NO: 877092 - protein, 193 aa, Homo sapiens
AGSGSQASPLCATCGPALLRAPTRAAMTRSLFKGNFWSADILSTIGYDNIIQHLNNGRKNCKEFEDFLKERAAIEERYGKDLLNLSRKKPCGQSEIKYVSSFFLVSRLVNNAWELPRFSRQSYQEVEVCWLKKNFFGDGISLFCPGWAQTQDPQSGAVAHASNPSTLGGRGRWIAWAQEFKTSLGNLAKPHPY

SEQ ID NO: 877093 - protein, 177 aa, Homo sapiens
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKMESHSVTQAGAQWHDLGSLQALPPGFMPFSCLSLPSSWNYRLPPPPRLAEPRNQDHGVA

SEQ ID NO: 877094 - protein, 236 aa, Homo sapiens
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVN

SEQ ID NO: 877095 - protein, 137 aa, Homo sapiens
MPPDGKKFHFIIRDPPLPGLNENPGVKWSQKPDQPLTSSVAGWPLPPSLSKPAVVTKSPATLWCFHAIQWVWKSLLSLRTLKYLLQFFGCKQQKPVPGPAQWLTPITLPLSEAEVGRLLKSSNLKPAWATWQNTIST

SEQ ID NO: 877096 - protein, 209 aa, Homo sapiens
FFLIQSLALSPRLECSDAISAHYKLRLPGSCHSPASASRVAGTTGAHHHAWLIFVVFLVETEFHHVSQDGLDLLTSGSAHLGLPKYWDYRREPPRPAALNPHRSLKTSPSAPCPWKNFLPQNWSLVPKRLETTALQHPCKVQTIILQLNRMQLREVPVTCSAEERQSWESPSRSVSPTPARTLEMEGLSLDSSYSNHGKGVCNSHNSDF

SEQ ID NO: 877097 - protein, 151 aa, Homo sapiens
GNTIMTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 877098 - protein, 233 aa, Homo sapiens
HLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERP

SEQ ID NO: 877099 - protein, 168 aa, Homo sapiens
MLPASLLRHPGLRRLMLQARTYAEAAAAPAPAAGPGQMSFTFASPTQVFFDSANVKQVDVPTLTGAFGILASHVPTLQVLRPGLVVVHTEDGTTTKYFVSSGSVTVNADSSVQLLAEEAVTLDMLDLGAARANLEKAQSELSGAADEAARAEIQIRIEANEALVKALE

SEQ ID NO: 877100 - protein, 206 aa, Homo sapiens
AGLLSAFGEREYTIKKETERREKVRRETEGKGREQKGPERAGEHRARGRHCRAGSAAAWAGAAAAARRRHVTRGRSCPRAERSQTPERTPRGHRCHRGSPGSSSVRRGRSSASGKTGDELKGGSGQGGTIFKDSRSLNAEPEETKGRWSGRHPRTGQARRPAWDSHLERSCQKEGLCCFGPGSELRCKPLPWQREPTQSIAACYKI

SEQ ID NO: 877101 - protein, 105 aa, Homo sapiens
LGVHRKPSFLALPGHLVKSEETVILQCWSDVMFEHFLLHREGKFNNTLHLIGEHHDGVSKANFSIGPMMPVLAGTYRCFGSFRDAPYEWSNSSDPLLVSVTGEET

SEQ ID NO: 877102 - protein, 87 aa, Homo sapiens
AVVRPPQRKKCPPEETHKFYSGGPTARPGRKGRPGPKAASPSQTRELVRGKVNRAAGRCKGKPKPVLPAKVNFNRGGWMRRRGGRTC

SEQ ID NO: 877103 - protein, 463 aa, Homo sapiens
MFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877104 - protein, 521 aa, Homo sapiens
SRLYAAYAISRPRRRCSGIGSNSMMYEDNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877105 - protein, 474 aa, Homo sapiens
RVATRRPRVADAWVDPRVRGSNSMMYETMGKRYMHHPQIQMISTVNLLVIHLLSHQPVCSLALSLCKSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877106 - protein, 536 aa, Homo sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877107 - protein, 340 aa, Homo sapiens
MSSNSSTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877108 - protein, 295 aa, Homo sapiens
MSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877109 - protein, 536 aa, Homo sapiens; identical to SEQ ID NO: 877106

SEQ ID NO: 877110 - protein, 280 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLVGYNT

SEQ ID NO: 877111 - protein, 116 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKLVILCK

SEQ ID NO: 877112 - protein, 69 aa, Homo sapiens
EQKIEREKERRMANNARERLRVRDINEAFKELGRMCQLHLKSEKPQTKLLILHQAVAVILSLEQQVRGK

SEQ ID NO: 877113 - protein, 682 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877114 - protein, 512 aa, Homo sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877115 - protein, 589 aa, Homo sapiens
MCYFTLDGVMECPDPRKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 877116 - protein, 362 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYFPDHTSCTFGKIKLY

SEQ ID NO: 877117 - protein, 161 aa, Homo sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMDMPCVQAQYSPSPPGSSYAAQTYSSEYTTEIMNPDYTKLTMDLGSTEITATAT

SEQ ID NO: 877118 - protein, 67 aa, Homo sapiens
TTRPPTGLRLQPPPCSQRALTSRSHPINLPSNINHKTRSEFSADTPSVTTAFHTSPQPGKSGSLGNC

SEQ ID NO: 877119 - protein, 161 aa, Homo sapiens
PLSPFPSSQRLGACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877120 - protein, 117 aa, Homo sapiens
KTFVSVQDRLCQNGPLYCIDSKLDFCPLLLQFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877121 - protein, 220 aa, Homo sapiens
TPGDWRAEGRRQAQAPAGALGSVLGPRGGGAGSGLRGRRPHPSPAGPAAMAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877122 - protein, 218 aa, Homo sapiens
RVSGWEGPGIGAVKGSPRGPAGSPETEVPLRPVLIPPPSPLPQGPAAMAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877123 - protein, 117 aa, Homo sapiens; identical to SEQ ID NO: 877120

SEQ ID NO: 877124 - protein, 195 aa, Homo sapiens
RVSGWEGPGIGAVKGSPRGPAGSPETEVPLRPVLIPPPSPLPQGPAAMAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSQVTSNFPAAKGNTRIPPTLLNPGQKHADLRAPGCY

SEQ ID NO: 877125 - protein, 221 aa, Homo sapiens
SQHAAPLAAARRPRKKFFPVGPNPGKGGGAPEPRRERNAQPALGSPGPAAMAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877126 - protein, 171 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877127 - protein, 171 aa, Homo sapiens; identical to SEQ ID NO: 877126

SEQ ID NO: 877128 - protein, 171 aa, Homo sapiens; identical to SEQ ID NO: 877126

SEQ ID NO: 877129 - protein, 171 aa, Homo sapiens; identical to SEQ ID NO: 877126

SEQ ID NO: 877130 - protein, 218 aa, Homo sapiens; identical to SEQ ID NO: 877122

SEQ ID NO: 877131 - protein, 171 aa, Homo sapiens; identical to SEQ ID NO: 877126

SEQ ID NO: 877132 - protein, 171 aa, Homo sapiens; identical to SEQ ID NO: 877126

SEQ ID NO: 877133 - protein, 163 aa, Homo sapiens
MTPTSLYVLLLAFRACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877134 - protein, 122 aa, Homo sapiens
MPLDEGMHIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877135 - protein, 80 aa, Homo sapiens
MTPSLQQTRSIAGYVFRDKVMSEFNNNFRQQMENYPKNNHTASILDRMQADFKCCGAANYTDWEKIPSMSKNRVPDSLLH

SEQ ID NO: 877136 - protein, 127 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYL

SEQ ID NO: 877137 - protein, 171 aa, Homo sapiens; identical to SEQ ID NO: 877126

SEQ ID NO: 877138 - protein, 204 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYQPSPRLPAALMLLWAVGLISTRRAIHKEGCVAATIGGWLRKNVLVVAAAALGIAFVEVLGIVFACCLVKSIRSGYEVM

SEQ ID NO: 877139 - protein, 101 aa, Homo sapiens
GRSGTARAAWFGLRKFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877140 - protein, 158 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDGEAVD

SEQ ID NO: 877141 - protein, 159 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADEKIPSMSKNRVPDSLLH

SEQ ID NO: 877142 - protein, 182 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADVSGVAGSRGGGNREFSSPRLGVVTHACNLSTFEGRGGQIT

SEQ ID NO: 877143 - protein, 191 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYRATQRATQLLGWLVGWPFVWLLAWLFVGTSLAPGVYRVSTPYIYSRNRRRHTSIFHLRYHNHRYP

SEQ ID NO: 877144 - protein, 114 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVSRE

SEQ ID NO: 877145 - protein, 67 aa, Homo sapiens
DSSGSFRQRTPEGDPEGGCVAATIGGWLRKNVLVVAAAALGIAFVEVLGIVFACCLVKSIRSGYEVM

SEQ ID NO: 877146 - protein, 125 aa, Homo sapiens
MKTIPSTDTELQPYSPSENKGNVLKCPLMATPRRAAVDVRQFPGAPLWVLAVLQGLNRPETVSMSVWSSWHLNGVSLPLGTFLPTFFLFFKQYTFVSAYFVAGTRQYQGGGRNKSKSLSLKNNLL

SEQ ID NO: 877147 - protein, 171 aa, Homo sapiens; identical to SEQ ID NO: 877126

SEQ ID NO: 877148 - protein, 101 aa, Homo sapiens; identical to SEQ ID NO: 877139

SEQ ID NO: 877149 - protein, 78 aa, Homo sapiens
DPPPGCVPIAGYVFRDKVMSEFNNNFRQQMENYPKNNHTASILDRMQADFKCCGAANYTDWEKIPSMSKNRVPDSLLH

SEQ ID NO: 877150 - protein, 144 aa, Homo sapiens
GTHHSCSLFLFPSPGLTGQRNPSVTADARVGCALEDSEGGSSGRELSWEPWRPVESIILGLCSGTDCRGCRGTACPESDHNPGGYPWLSVASGHHRSGCLPLPGGFCGLLRGLQGELLSYDHVCHLSVSYHVGGGGRSHCWLCV

SEQ ID NO: 877151 - protein, 110 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDK

SEQ ID NO: 877152 - protein, 174 aa, Homo sapiens
MTPTSLYVLLLAFRACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADVSGVAGSRGGGNREFSSPRLGVVTHACNLSTFEGRGGQIT

SEQ ID NO: 877153 - protein, 171 aa, Homo sapiens; identical to SEQ ID NO: 877126

SEQ ID NO: 877154 - protein, 171 aa, Homo sapiens; identical to SEQ ID NO: 877126

SEQ ID NO: 877155 - protein, 171 aa, Homo sapiens; identical to SEQ ID NO: 877126

SEQ ID NO: 877156 - protein, 220 aa, Homo sapiens; identical to SEQ ID NO: 877121

SEQ ID NO: 877157 - protein, 222 aa, Homo sapiens
PGGLRRGLGETTRSPFLQGSPQARGDSSGALQPPWSNFASKFPGPGQGPAAMAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSLLH

SEQ ID NO: 877158 - protein, 144 aa, Homo sapiens; identical to SEQ ID NO: 877150

SEQ ID NO: 877159 - protein, 171 aa, Homo sapiens; identical to SEQ ID NO: 877126

SEQ ID NO: 877160 - protein, 171 aa, Homo sapiens; identical to SEQ ID NO: 877126

SEQ ID NO: 877161 - protein, 171 aa, Homo sapiens; identical to SEQ ID NO: 877126

SEQ ID NO: 877162 - protein, 218 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWAVGLISTRRAIHKEGCVAATIGGWLRKNVLVVAAAALGIAFVEVLGIVFACCLVKSIRSGYEVM

SEQ ID NO: 877163 - protein, 204 aa, Homo sapiens; identical to SEQ ID NO: 877138

SEQ ID NO: 877164 - protein, 150 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAAN

SEQ ID NO: 877165 - protein, 162 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYRFGNCLCLLPREEYQKWLRGDVGVWSPQASSSGGVE

SEQ ID NO: 877166 - protein, 127 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKAMPPLPPPFRPPMAHSP

SEQ ID NO: 877167 - protein, 78 aa, Homo sapiens
QGRDRGTRRGLGWEVSDGAFVLCACHLQGCVAATIGGWLRKNVLVVAAAALGIAFVEVLGIVFACCLVKSIRSGYEVM

SEQ ID NO: 877168 - protein, 186 aa, Homo sapiens [sequence omitted]

SEQ ID NO: 877169 - protein, 112 aa, Homo sapiens
MMNYVGKRKKRRKRDPQAPRRPPSSFLLFCQDHYAQLKRENPNWSVVQVAKATGKMWSTATDLEKHPYEQRVALLRAKYFEELELYRKQCNARKKYRMSARNRCRGKRVRQS

SEQ ID NO: 877170 - protein, 150 aa, Homo sapiens
RGPRQTATDTGRARVSFWRFPLDPGVKNSNVQISGEKRRFRTLRSLFHPFPVTRSGAPRAVLVGSSWPAKMVAPAVKVARGWSGLALGVRRAVLQLPGLTQVRWSRYSPEFKDPLIDKEYYRKPVEELTEEEKYVRERHMRGLSSESSAY

SEQ ID NO: 877171 - protein, 152 aa, Homo sapiens
RGPRQTATDTGRARVSFWRFPLDPGVKNSNVQISGEKRRFRTLRSLFHPFPVTRSGAPRAVLVGSSWPAKMVAPAVKVARGWSGLALGVRRAVLQLPGLTQVRWSRYSPEFKDPLIDKEYYRKPVEELTEEEKYVRERHMERYLKSRTDVFY

SEQ ID NO: 877172 - protein, 312 aa, Homo sapiens
RGPRQTATDTGRARVSFWRFPLDPGVKNSNVQISGEKRRFRTLRSLFHPFPVTRSGAPRAVLVGSSWPAKMVAPAVKVARGWSGLALGVRRAVLQLPGLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 877173 - protein, 220 aa, Homo sapiens
MPANSRLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 877174 - protein, 169 aa, Homo sapiens
RGPRQTATDTGRARVSFWRFPLDPGVKNSNVQISGEKRRFRTLRSLFHPFPVTRSGAPRAVLVGSSWPAKMVAPAVKVARGWSGLALGVRRAVLQLPGLTQVRWSRYSPEFKDPLIDKEYYRKPVEELTEEEKYVRELKKTQLIKAAPAGKTSSVFEDPVIRLDGNKHG

SEQ ID NO: 877175 - protein, 312 aa, Homo sapiens; identical to SEQ ID NO: 877172

SEQ ID NO: 877176 - protein, 312 aa, Homo sapiens; identical to SEQ ID NO: 877172

SEQ ID NO: 877177 - protein, 271 aa, Homo sapiens
MSSYLGQGPELLWLRFSSRSPRRSPSSARWQSCLLLSQTYSLVESAFACLLLSPPPRLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 877178 - protein, 146 aa, Homo sapiens
MMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 877179 - protein, 134 aa, Homo sapiens
MILLQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 877180 - protein, 115 aa, Homo sapiens
MILLQTLEAVKRKQFEKYHAASAEEQATIERNPYTIFHQALKNCEPMIGLVPILKGGRFYQVPVPLPDRRRRFLAMKWMITECRDKKHQRTLMPEKHDLHKMAEANRALAHYRWW

SEQ ID NO: 877181 - protein, 306 aa, Homo sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAASGPSWASWLRCWCWSTIIFIYEKRRKPEDVLDDDDGGSDPCKSSGQHQKDNGKKVRQKKLSGGQWPRNHTNTDCDPDRSTITRRADHRVSAVKETRTEIHKKPLYKTGVPQRNRAANTSTRVPTSERRDQGQPASYRGTHRENQINRRPALTQHVVRRAATH

SEQ ID NO: 877182 - protein, 334 aa, Homo sapiens
MLLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAASGPSWASWLRCWCWSTIIFIYEKRRKPEDVLDDDDGGSDPCKSSGQHQKDNGKKVRQKELSGGQWPRNHTNTDCDPDRSTIRGEQITGSQREGNAHRDPQEATDIKQGYHRGIGQQIHPRGYQRASDVTRGNRRATGGHTAKTRLTDGQHYLSTLCAAPRRM

SEQ ID NO: 877183 - protein, 511 aa, Homo sapiens
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 877184 - protein, 511 aa, Homo sapiens; identical to SEQ ID NO: 877183

SEQ ID NO: 877185 - protein, 578 aa, Homo sapiens
VSGILTQPGRNARAWPLNLRAPGLRTRTWTGTLLAGPQLASLLSVSTPAKDKDFSSGRPPPAEGTFQVFPRPWLRARCRLCRGFLSPQDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 877186 - protein, 604 aa, Homo sapiens
KCLGRVWGPWTEPSAGSLRPMARKQNRNSKELGLVPLTDDTSHARPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGNSSKELRQRSWRPSGESQDFPQLCLAGLLLVFSVCREEQELPFYLAYLHL

SEQ ID NO: 877187 - protein, 604 aa, Homo sapiens; identical to SEQ ID NO: 877186

SEQ ID NO: 877188 - protein, 581 aa, Homo sapiens
KCLGRVWGPWTEPSAGSLRPMARKQNRNSKELGLVPLTDDTSHARPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGNDLMSRRQTCRNECAWIPESPGEGNSH

SEQ ID NO: 877189 - protein, 117 aa, Homo sapiens
MELAHMIMEAEKSLDRPSASWRPWDSGGTAQSKSRSFSTRKANGNSQSDAKGLRTRAMDGTLVQVLKSKGQGARSSDLQEQEKKSIPAPGERQTEKQNKTKQTNKRKCLFFCPFCLI

SEQ ID NO: 877190 - protein, 560 aa, Homo sapiens
KCLGRVWGPWTEPSAGSLRPMARKQNRNSKELGLVPLTDDTSHARPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 877191 - protein, 121 aa, Homo sapiens
PPPKKNTHCKRSCGISSTWNDLPLSSSPGEHQVMMSDKSLDFGDMVTSCQEGRPAEMNVPGYLSHQVKETPIDLHHTPDMKPFFFCTVTEVRDYYSLQLSLALSCLTNISFNKCCSISHGF

SEQ ID NO: 877192 - protein, 518 aa, Homo sapiens
MARKQNRNSKELGLVPLTDDTSHARPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPLAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQVLSTCILCCLRPKTEPMQKSARHFPKGTKHTHQKRKSTQLSLMVR

SEQ ID NO: 877193 - protein, 80 aa, Homo sapiens
VSGILTQPGRNARAWPLNLRAPGLRTRTWTGTLLAGPQLASLLSVSTPAKDKDFSSGRPPPAEGTFQVFPRPWLRARCRL

SEQ ID NO: 877194 - protein, 111 aa, Homo sapiens
LRNSLLLPPLHLDNSTPAKMSCQQNQQQCQPPPKCPSPKCPPKSPVQCLPPASSGCAPSSGGCGPSSEGGCFLNHHRRHHRCRRQRPNSCDRGSGQQGGGSGCGHGSGGCC

SEQ ID NO: 877195 - protein, 142 aa, Homo sapiens
IWHVPPTPHQLPSPSCSSCLRRPLVLETLDCRFWTNKWLCFVQDNSTPAKMSCQQNQQQCQPPPKCPSPKCPPKSPVQCLPPASSGCAPSSGGCGPSSEGGCFLNHHRRHHRCRRQRPNSCDRGSGQQGGGSGCGHGSGGCC

SEQ ID NO: 877196 - protein, 143 aa, Homo sapiens
MQRRTPLRSGSKAVHLVFSRAWVSMSCILIAWNKDGTLPLQIVVAGLPSWNLLLSSVRFIPEFLLPPDTLSWRISCCGIRLVTSRGRFSGNGSLSIVPAAVWEPEVKKPLHRERRPVLPQVILLFFHRSLPLCKPGSSVLLRG

SEQ ID NO: 877197 - protein, 142 aa, Homo sapiens
STLLAYSLAWTLRHIPPALTLWCPAASGFMGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 877198 - protein, 155 aa, Homo sapiens
VFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYKCNECGKAFRGHSNLTPTECHP

SEQ ID NO: 877199 - protein, 102 aa, Homo sapiens
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 877200 - protein, 142 aa, Homo sapiens; identical to SEQ ID NO: 877197

SEQ ID NO: 877201 - protein, 117 aa, Homo sapiens
STLLAYSLAWTLRHIPPALTLWCPAASGFMGGLEPCSRLLLLPLLLAVSGGELGASVAASRVPGLSLGQGREWGGTREPKVGVGMGAGPQPPKACGFLPEPKPPSFVVRYKQGRRDI

SEQ ID NO: 877202 - protein, 142 aa, Homo sapiens; identical to SEQ ID NO: 877197

SEQ ID NO: 877203 - protein, 142 aa, Homo sapiens; identical to SEQ ID NO: 877197

SEQ ID NO: 877204 - protein, 142 aa, Homo sapiens; identical to SEQ ID NO: 877197

SEQ ID NO: 877205 - protein, 117 aa, Homo sapiens; identical to SEQ ID NO: 877201

SEQ ID NO: 877206 - protein, 294 aa, Homo sapiens
SGLPPRRPLLLLLLPPLPPPLPGYSAARAELAADFARRSARAAGGWGTAGAAAAALAEAAGAAKGSLSRAGLNNFETVHRCHVLNMSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNGKQ

SEQ ID NO: 877207 - protein, 922 aa, Homo sapiens
SGLPPRRPLLLLLLPPLPPPLPGYSAARAELAADFARRSARAAGGWGTAGAAAAALAEAAGAAKGSLSRAGLNNFETVHRCHVLNMSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGMKFRLPAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 877208 - protein, 285 aa, Homo sapiens
MVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGMKFRLPAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 877209 - protein, 646 aa, Homo sapiens
SGLPPRRPLLLLLLPPLPPPLPGYSAARAELAADFARRSARAAGGWGTAGAAAAALAEAAGAAKGSLSRAGLNNFETVHRCHVLNMSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQSESTISKCVG

SEQ ID NO: 877210 - protein, 922 aa, Homo sapiens; identical to SEQ ID NO: 877207

SEQ ID NO: 877211 - protein, 494 aa, Homo sapiens
SGLPPRRPLLLLLLPPLPPPLPGYSAARAELAADFARRSARAAGGWGTAGAAAAALAEAAGAAKGSLSRAGLNNFETVHRCHVLNMSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIECKLLSFVFSLK

SEQ ID NO: 877212 - protein, 184 aa, Homo sapiens
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRDKDYRARGRDDKARCCLSVIHSLEAQDFWWML

SEQ ID NO: 877213 - protein, 490 aa, Homo sapiens
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRDKDYRARGRDDKGRKNMQDGASDGEMPKFDGAGYDKDLVEALERDIVSRNPSIHWDDIADLEEAKKLLREAVVLPMWMPDFFKGIRRPWKGVLMVGPPGTGKTMLAKAVATECGTTFFNVSSSTLTSKYRGESEKLVRLLFEMARFYAPTTIFIDEIDSICSRRGTSDEHEASRRVKSELLIQMDGVGGALENDDPSKMVMVLAATNFPWDIDEALRRRLEKRIYIPLPTAKGRAELLKINLREVELDPDIQLEDIAEKIEGYSGADITNVCRDASLMAMRRRINGLSPEEIRALSKEELQMPVTKGDFELALKKIAKSVSAADLEKYEKWMVEFGSA

SEQ ID NO: 877214 - protein, 490 aa, Homo sapiens; identical to SEQ ID NO: 877213

SEQ ID NO: 877215 - protein, 490 aa, Homo sapiens; identical to SEQ ID NO: 877213

SEQ ID NO: 877216 - protein, 154 aa, Homo sapiens
MHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSAVTAPASNLAVVPPLLPLGCLQQAAA

SEQ ID NO: 877217 - protein, 154 aa, Homo sapiens; identical to SEQ ID NO: 877216

SEQ ID NO: 877218 - protein, 177 aa, Homo sapiens
MHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSAAWEVKKARLCPGLIQFCFYSQLPSQKRVKSHLSCVFSSPTWHEHLNQT

SEQ ID NO: 877219 - protein, 165 aa, Homo sapiens
WDHNLKWINVFSYEMDGQKDLYTHPVSPQRSGGIAIRGHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 877220 - protein, 105 aa, Homo sapiens
SSIGTEKALNLCSDLPLSPGGSGDLGDGRTPKADCCPQLSGLHMDQTQLAVRGQEHLDAAHTGQFQGAVQHGKGEMYLKRQMKDIQRHRQSCFYYHKNSLRFLDT

SEQ ID NO: 877221 - protein, 104 aa, Homo sapiens
VKLLTSNDPPASASQSAGITYMTHHTQPREGFRGRNSSCMIFSRFSREGSELWERKEDGGNGKKRSTLLRKGTELGVVAHACNPALWEAEAVGSLEPRSLRPAT

SEQ ID NO: 877222 - protein, 388 aa, Homo sapiens
QFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQALMQECFSRS

SEQ ID NO: 877223 - protein, 194 aa, Homo sapiens
MLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQALMQEVFFTELTENIFHCVS

SEQ ID NO: 877224 - protein, 153 aa, Homo sapiens
MGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISVSAGRAKGRGPRLGTHSPSLSPRRRLASAAGQPDSRVPLACLIRYIQMEAHLESL

SEQ ID NO: 877225 - protein, 239 aa, Homo sapiens [sequence omitted]

SEQ ID NO: 877226 - protein, 178 aa, Homo sapiens
RRRVEKGRKRREERKRGEKEVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSAKSKSPVKSTERTAKLTLNSKHHPAPTVL

SEQ ID NO: 877227 - protein, 176 aa, Homo sapiens
TAPGQRRDSPGTAPGKARGRRGVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 877228 - protein, 199 aa, Homo sapiens
MSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 877229 - protein, 147 aa, Homo sapiens
RRRRWEKGESELCRQNSDSGREQISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGQFRSLVTGF

SEQ ID NO: 877230 - protein, 235 aa, Homo sapiens
MGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 877231 - protein, 243 aa, Homo sapiens
MGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 877232 - protein, 144 aa, Homo sapiens
SSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKS

SEQ ID NO: 877233 - protein, 92 aa, Homo sapiens
QTTTKNDTKEESSGEGQVGGERLWMKLQDKDIGFSLVLLVQGAVDGDSDKLNAQNWEGTMQSLINAYDLHCHYCCFLEHNFLYKDLHCTVCG

SEQ ID NO: 877234 - protein, 133 aa, Homo sapiens
QDPQSLDTGPTLKKHGQQEGGMVSRPSESLRKEPSREDRCVECDTTWHFSSPADPVSANTSNLTSAPGLLFTCLGSELRRKDEKRLQCSRHPLQSEAARPSLPALGCSGGDVNHSKECLKEDLEFPPCKLGKN

SEQ ID NO: 877235 - protein, 104 aa, Homo sapiens
QDPQSLDTGPTLKKHGQQEGGMVSRPSESLRKEPSREDRCVECDTTWHFSSPADPVSANTSNLTSAPGLLFTCLGSELRRKDEKRLQCSRHPLQSEAARPSLPQ

SEQ ID NO: 877236 - protein, 133 aa, Homo sapiens; identical to SEQ ID NO: 877234

SEQ ID NO: 877237 - protein, 177 aa, Homo sapiens
GRKGSWWKVRQRESLREQGKKVAGCVRERKVQSYPCEAEWGPMGLAPPVVQSMPLPPGDGGLHELGHHPDHAAGAGGQPHHADRRGEWPGGAGPAQPAARGRLCRGRELCAQPGGPAVTEVGRLEELAVPRRCAPPLPRDVLEGSCPLPTASCLCADPAGLRPAATLRLSPARPAWP

SEQ ID NO: 877238 - protein, 324 aa, Homo sapiens
ATHKRSSATACVTMATAAGSRAPPLWRDRPPSSRESIPCDRKWGGDPGSPRRVQLGRFDRRRDLTPPGVGVPSPSPSAAPVIVAMDVHGEAAGEAGQEGGEGLQGGAGQSEEGPSAEKCRVCPCVCRERHPQEERRCELASDGVPRRRSGLQGADSCDYEGGDQEYGPGDQSPGQGPEHHGPAEGLLSDGQVRAAGAEPGRPYIGDGGLHELGHHPDHAAGAGGQPHHADRRGEWPGGAGPAQPAARGRLCRGRELCAQPGGPAVTEVGRLEELAVPRRCAPPLPRDVLEGSCPLPTASCLCADPAGLRPAATLRLSPARPAWP

SEQ ID NO: 877239 - protein, 280 aa, Homo sapiens
ATHKRSSATACVTMATAAGSRAPPLWRDRPPSSRESIPCDRKWGGDPGSPRRVQLGRFDRRRDLTPPGVGVPSPSPSAAPVIVAMDDTLFQLKFTAKQLEKLAKKAEKDSKAEQAKVKKALLQKNVECARVYAENAIRKKNEGVNWLRMASRVDAVASKVQTAVTMKGVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 877240 - protein, 280 aa, Homo sapiens; identical to SEQ ID NO: 877239

SEQ ID NO: 877241 - protein, 280 aa, Homo sapiens; identical to SEQ ID NO: 877239

SEQ ID NO: 877242 - protein, 280 aa, Homo sapiens; identical to SEQ ID NO: 877239

SEQ ID NO: 877243 - protein, 280 aa, Homo sapiens; identical to SEQ ID NO: 877239

SEQ ID NO: 877244 - protein, 280 aa, Homo sapiens; identical to SEQ ID NO: 877239

SEQ ID NO: 877245 - protein, 280 aa, Homo sapiens; identical to SEQ ID NO: 877239

SEQ ID NO: 877246 - protein, 232 aa, Homo sapiens
ATHKRSSATACVTMATAAGSRAPPLWRDRPPSSRESIPCDRKWGGDPGSPRRVQLGRFDRRRDLTPPGVGVPSPSPSAAPVIVAMDVHGEAAGEAGQEGGEGLQGGAGQSEEGPSAEKCRVCPCVCRERHPQEERRCELASDGVPRRRSGLQGADSCDYEGGDQEYGPGDQSPGQGPEHHGPAEGLLSDGQVRAAGAEPGRPYIGMWPLPLGLWPGDKERVWAAHREGWLTG

SEQ ID NO: 877247 - protein, 280 aa, Homo sapiens; identical to SEQ ID NO: 877239

SEQ ID NO: 877248 - protein, 163 aa, Homo sapiens [sequence omitted]

SEQ ID NO: 877249 - protein, 280 aa, Homo sapiens; identical to SEQ ID NO: 877239

SEQ ID NO: 877250 - protein, 280 aa, Homo sapiens; identical to SEQ ID NO: 877239

SEQ ID NO: 877251 - protein, 106 aa, Homo sapiens
PALRRPQKTGHTTHGPGQESPGARESYRAEMRPGVGQETPVCLPETVMWWPPVPERWKIGCLAQRSVSCPLEGCTCCLSWQGWREVASAEAWGPLLHPLGWEPSPH

SEQ ID NO: 877252 - protein, 135 aa, Homo sapiens
QSLALPAFQPSLSPLPSLLSKVLVLFFRVPPTVLPSPRRTLAPRLPLPLCFFPKVLPRKSRDSGVSAAAGRRAGRAPGLPQLLSSWRKLLLPPGPAPCAGRPSSGGGCDPDLGGGKDRKARVLVLCSPAQASRRP

SEQ ID NO: 877253 - protein, 335 aa, Homo sapiens
GKKLSAEGGRTALLRAVLRKLLDPRLISTEENTQTAETMGLLSAPPCTQRITWKGLLLTVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLNPRENKDVLNFTCEPKSENYTYIWWLNGQSLPVSPRVKRPIENRILILPSVTRNETGPYQCEIRDQYGGIRSDPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 877254 - protein, 285 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877255 - protein, 256 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 877256 - protein, 267 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSAYSSSINYTSGNRN

SEQ ID NO: 877257 - protein, 258 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTLP

SEQ ID NO: 877258 - protein, 285 aa, Homo sapiens; identical to SEQ ID NO: 877254

SEQ ID NO: 877259 - protein, 267 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 877260 - protein, 274 aa, Homo sapiens
TRYAVDLTRLREESGDWVHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877261 - protein, 282 aa, Homo sapiens
MRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877262 - protein, 236 aa, Homo sapiens
MPTLIEGYLWRNQRCHTGQSSLCFHTAKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877263 - protein, 192 aa, Homo sapiens
MEAVSLTCDPETPDASYLWWMNGQSLPMTHSLKLSETNRTLFLLGVTKYTAGPYECEIRNPVSASRSDPVTLNLLHGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877264 - protein, 192 aa, Homo sapiens; identical to SEQ ID NO: 877263

SEQ ID NO: 877265 - protein, 267 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 877266 - protein, 169 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPREDHGGCELNL

SEQ ID NO: 877267 - protein, 151 aa, Homo sapiens
HRQVVLHRQVVLHRQVVLHRQVVLHRQVVLHRRLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877268 - protein, 267 aa, Homo sapiens; identical to SEQ ID NO: 877265

SEQ ID NO: 877269 - protein, 158 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHRMKLYRRSLEPPHPA

SEQ ID NO: 877270 - protein, 79 aa, Homo sapiens
SNSIYHGRNIKLFIRHITTKHSGLYVCSVRNSATGKESSKSMTVEVSDWTVTLNSTSTSNSIFSHGITKSKTHSVPEAL

SEQ ID NO: 877271 - protein, 582 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHRMKLYRRSLEPPHPAYLKPDTHRTTPYSPDPSSWQTTILHSDSLWNPRDIRSFLGLCSIFRGHWLKSATMRHLGKLRHLVVHCLMTELTSGLDSVLPCVISAEVPSPRPGFPVPKGFKDNWKFHHPSLGCPWQGKLQRKHTLGGKVRLKLRRFQHCMLQVRTQVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLNPRENKDVLNFTCEPKSENYTYIWWLNGQSLPVSPRVKRPIENRILILPSVTRNETGPYQCEIRDQYGGIRSDPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 877272 - protein, 165 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPNLHLQQQLNPMSRSRGTD

SEQ ID NO: 877273 - protein, 154 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTAPGTFPVITGCTTTPLVSS

SEQ ID NO: 877274 - protein, 165 aa, Homo sapiens
MEAVSLTCDPETPDASYLWWMNGQSLPMSHRLQLSETNRTLFLLGVTKYTAGPYECEIRNPVSASRSDPVTLNLLHGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 877275 - protein, 265 aa, Homo sapiens
MEAVSLTCDPETPDASYLWWMNGQSLPMSHRLQLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDQYGGIRSDPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 877276 - protein, 265 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSGKWIPASLAIGF

SEQ ID NO: 877277 - protein, 41 aa, Homo sapiens
MGTLSAPPCTQRIKWKGLLLTASLLNFWNLPPPPLSIQEGR

SEQ ID NO: 877278 - protein, 265 aa, Homo sapiens; identical to SEQ ID NO: 877276

SEQ ID NO: 877279 - protein, 285 aa, Homo sapiens; identical to SEQ ID NO: 877254

SEQ ID NO: 877280 - protein, 285 aa, Homo sapiens; identical to SEQ ID NO: 877254

SEQ ID NO: 877281 - protein, 203 aa, Homo sapiens
MEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSTQCHEK

SEQ ID NO: 877282 - protein, 353 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877283 - protein, 169 aa, Homo sapiens; identical to SEQ ID NO: 877266

SEQ ID NO: 877284 - protein, 159 aa, Homo sapiens
GPSLAQWSSVVLEQCVMVVEFCVKLAVVCFEDLPSPAAGVFQHGPDLPRIYPSFTYYRSGEVLYLSCSADSNPPAQYSWTINEKFQLPGQKLFIRHITTKHSGLYVCSVRNSATGKESSKSMTVEVSDWTVTLNSTSTSNSIFSHGITKSKTHSVPEAL

SEQ ID NO: 877285 - protein, 589 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHRMKLYRRSLEPPHPAYLKPDTHRTTPYSPDPSSWQTTILHSDSLWNPRDIRSFLGLCSIFRGHWLKSATMRHLGKLRHLVVHCLMTELTSGLDSVLPCVISAEVPSPRPGFPVPKGFKDNWKFHHPSLGCPWQGKLQRKHTLGGKVRLKLRRFQHCMLQVRTQVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLNPRENKDVLNFTCEPKSENYTYIWWLNGQSLPVSPRVKRPIENRILILPSVTRNETGPYQCEIRDQYGGIRSDPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 877286 - protein, 183 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLL

SEQ ID NO: 877287 - protein, 165 aa, Homo sapiens; identical to SEQ ID NO: 877274

SEQ ID NO: 877288 - protein, 102 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGCSPGLCSPVR

SEQ ID NO: 877289 - protein, 295 aa, Homo sapiens
GTSVYAARSDYAARSATRLSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 877290 - protein, 82 aa, Homo sapiens
MSVCPVDLPRRAQRLWLRAPARLRRKPPVLDPLPAHSGMCGNCRLASGTGRREVATPAPRHTAMVLPPDALLWCGLSAQYLV

SEQ ID NO: 877291 - protein, 137 aa, Homo sapiens
MSQVGRVRSSHHFESVCLDAEVRVVLVALDHAGLHTLSSALNESLRPIHREELHLLHFPNSPEENLRKRPAEPSPQIHGGAPHLPWLCVEKSDLLPENHAVFLQERTAQLFEGSFFFSRSPAHSISPLLQFRWGHCP

SEQ ID NO: 877292 - protein, 482 aa, Homo sapiens
RRAGLPGAWGPGLQRLRKVGSASGTMLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 877293 - protein, 464 aa, Homo sapiens
RRAGLPGAWGPGLQRLRKVGSASGTMLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 877294 - protein, 289 aa, Homo sapiens
RRAGLPGAWGPGLQRLRKVGSASGTMLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKV

SEQ ID NO: 877295 - protein, 482 aa, Homo sapiens; identical to SEQ ID NO: 877292

SEQ ID NO: 877296 - protein, 435 aa, Homo sapiens
RRAGLPGAWGPGLQRLRKVGSASGTMLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRSVS

SEQ ID NO: 877297 - protein, 482 aa, Homo sapiens; identical to SEQ ID NO: 877292

SEQ ID NO: 877298 - protein, 93 aa, Homo sapiens
AYTHNHYNSRVKVPHTDMRPAQYLLSPRYPLFRKSYVGTPSRAQGTANRRIAPTLYCMAPQALLTGRYKETLLHLVDALDWYRPVDFSISPPL

SEQ ID NO: 877299 - protein, 482 aa, Homo sapiens; identical to SEQ ID NO: 877292

SEQ ID NO: 877300 - protein, 482 aa, Homo sapiens; identical to SEQ ID NO: 877292

SEQ ID NO: 877301 - protein, 214 aa, Homo sapiens
RRAGLPGAWGPGLQRLRKVGSASGTMLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKTESHSVIQAGVQWHDLDSLQAPPPGFTPFSCLSLLSSWDYRRPPPHPANFLYF

SEQ ID NO: 877302 - protein, 674 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877303 - protein, 705 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877304 - protein, 705 aa, Homo sapiens; identical to SEQ ID NO: 877303

SEQ ID NO: 877305 - protein, 180 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVVRGPQNNVRSLGISVSALVS

SEQ ID NO: 877306 - protein, 728 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877307 - protein, 726 aa, Homo sapiens
MCPQYLSQSPNPSCPTAFSWDLPWEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877308 - protein, 654 aa, Homo sapiens
MKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877309 - protein, 380 aa, Homo sapiens [sequence omitted]

SEQ ID NO: 877310 - protein, 674 aa, Homo sapiens; identical to SEQ ID NO: 877302

SEQ ID NO: 877311 - protein, 674 aa, Homo sapiens; identical to SEQ ID NO: 877302

SEQ ID NO: 877312 - protein, 674 aa, Homo sapiens; identical to SEQ ID NO: 877302

SEQ ID NO: 877313 - protein, 542 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELTLMTSVNPRD

SEQ ID NO: 877314 - protein, 586 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICECSPGQTSSPAACMPCLSLPSVCALWLFPGPSPKCHLIFGTTT

SEQ ID NO: 877315 - protein, 416 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILYLEEISRIQSLRSPSVHQTQHVEMYPLQRKETFYLRKASPL

SEQ ID NO: 877316 - protein, 378 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGEYRSPARGQPLTLPSQRSPDGLLLPGPAGPTLL

SEQ ID NO: 877317 - protein, 145 aa, Homo sapiens
MCPQYLSQSPNPSCPTAFSWDLPWEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLRTYDLEPMTCEPM

SEQ ID NO: 877318 - protein, 160 aa, Homo sapiens
MCPQYLSQSPNPSCPTAFSWDLPWEASARRREIEDKLKQEEETLSFIRDSLEKSDQLTKNMVSLPAAGGEGRPPDPGGEPCDLAVPVPAAWSSGMGSDGGSVWVYLATVWHLSCLAPSPCSVPSLRRLHFPLAWTCCFLSKLAILPSLLLQTLSESDQLG

SEQ ID NO: 877319 - protein, 106 aa, Homo sapiens
MKLENSIIPVHKQTENLQRLQENVEKTLSCLDHVISYYHVASDTEKIIREGPTGRLEEYLGSMAKIQKAVEYFQDNSPDSPELNKVVRGPQNNVRSLGISVSALVS

SEQ ID NO: 877320 - protein, 304 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGEPPSWPISATARG

SEQ ID NO: 877321 - protein, 78 aa, Homo sapiens
SVYFRVKHREMQPCSSGRSLVRHEHDFRVKHLSEALNDKHGPLAGEYRSPARGQPLTLPSQRSPDGLLLPGPAGPTLL

SEQ ID NO: 877322 - protein, 697 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877323 - protein, 568 aa, Homo sapiens
TLGSEAGLRAVTLRRYQRGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877324 - protein, 458 aa, Homo sapiens
AAAYYYYIRGRSIKGLKEHFHKSSSSSGVPYSPAIPNKRKDTPTKKPVKRPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877325 - protein, 426 aa, Homo sapiens
RDKERQIIKERFKGFNDGLEELCKIQKAWAIPDTEQRDRIRQAQKTIVKETYGAFLQKFGSVPFTKNPEKYIKYGVEQVGDMIIAFSTPLPEPAASPAWFHQTIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877326 - protein, 326 aa, Homo sapiens
YLNVGYLQAVTSPESLVFTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 877327 - protein, 674 aa, Homo sapiens; identical to SEQ ID NO: 877302

SEQ ID NO: 877328 - protein, 674 aa, Homo sapiens; identical to SEQ ID NO: 877302

SEQ ID NO: 877329 - protein, 674 aa, Homo sapiens; identical to SEQ ID NO: 877302

SEQ ID NO: 877330 - protein, 674 aa, Homo sapiens; identical to SEQ ID NO: 877302

SEQ ID NO: 877331 - protein, 568 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQPPVFQPGVKLRDKER

SEQ ID NO: 877332 - protein, 457 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQSTRPRI

SEQ ID NO: 877333 - protein, 391 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRASCIQGVEVFFWGIL

SEQ ID NO: 877334 - protein, 310 aa, Homo sapiens
RGPGGPAEERYWGVGAAGFRAMIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVADWSPGVMETFDGFWQGQTWTQNRSIEGLPKPCFATSQIVSS

SEQ ID NO: 877335 - protein, 109 aa, Homo sapiens
MCPQYLSQSPNPSCPTAFSWDLPWEASARRREIEDKLKQEEETLSFIRDSLEKSDQLTKNMVSILSSFESRLMKLENFDGFWQGQTWTQNRSIEGLPKPCFATSQIVSS

SEQ ID NO: 877336 - protein, 68 aa, Homo sapiens
YFLSCLWEKVDKHPSGIREQRMHVAIRTQETGPDQGCLGKSGGRLLCSEVSFLCYLSWLPSSGTRSGR

SEQ ID NO: 877337 - protein, 580 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877338 - protein, 736 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877339 - protein, 711 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877340 - protein, 659 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPGE

SEQ ID NO: 877341 - protein, 616 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPDWRSVLVFILLAVAPPAPPSSSQLCRYFPACKKMECPFYHPKHCRFNTQCTRPDCTFYHPTINVPPRHALKWIRPQTSE

SEQ ID NO: 877342 - protein, 580 aa, Homo sapiens; identical to SEQ ID NO: 877337

SEQ ID NO: 877343 - protein, 580 aa, Homo sapiens; identical to SEQ ID NO: 877337

SEQ ID NO: 877344 - protein, 580 aa, Homo sapiens; identical to SEQ ID NO: 877337

SEQ ID NO: 877345 - protein, 570 aa, Homo sapiens
MSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877346 - protein, 411 aa, Homo sapiens
MSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877347 - protein, 280 aa, Homo sapiens
MSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877348 - protein, 475 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGDLSFLSGCFQDLLFVFDVLQFHYDVSRRGFPFIFPVWYNVWKHPIYLK

SEQ ID NO: 877349 - protein, 725 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877350 - protein, 605 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877351 - protein, 736 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPDWRSVLVFILLAVAPPAPPSSSQLCRYFPACKKMECPFYHPKHCRFNTQCTRPDCTFYHPTINVPPRHALKWIRPQTSE

SEQ ID NO: 877352 - protein, 745 aa, Homo sapiens
MEIGTEISRKIRSAIKGKLQELGAYVVFEIPVEMKRKKLKLSHLVQYEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877353 - protein, 283 aa, Homo sapiens
MAETLQMSQDTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877354 - protein, 380 aa, Homo sapiens
RGSPTDSGSATKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 877355 - protein, 580 aa, Homo sapiens; identical to SEQ ID NO: 877337

SEQ ID NO: 877356 - protein, 725 aa, Homo sapiens; identical to SEQ ID NO: 877349

SEQ ID NO: 877357 - protein, 35 aa, Homo sapiens
KQFVVGRYVRRGVYSWKKAHKIYPEPRCLSKTNQH

SEQ ID NO: 877358 - protein, 82 aa, Homo sapiens
RAWQQRLIAARQQLHRELIWTAVRPPGLPHAPRDCHGQEGRKQKMQLTIQTPCLVLPRTGCAPDSGFSRIRMSLLGSRVTGP

SEQ ID NO: 877359 - protein, 69 aa, Homo sapiens
AGIALNNHCVKLISWYENEFGYSNRVGTSWPTSPPRSKTPEPPAPVTAQEEKRGPHCWGVPATLSPLPQ

SEQ ID NO: 877360 - protein, 90 aa, Homo sapiens
HPAPGLKVSATFIGNSTAIQELFKRISEQFTAMFRRKAFLHWYTGEGMDEMEFTEAESNMNDLVSEYQQYQDATAEEEGEFEEEAEEEVA

SEQ ID NO: 877361 - protein, 90 aa, Homo sapiens; identical to SEQ ID NO: 877360

SEQ ID NO: 877362 - protein, 791 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTDDISYSLVLTGPPPTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 877363 - protein, 867 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQNVTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 877364 - protein, 843 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 877365 - protein, 814 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAAAVHGARFKGQDLKLAWNKPVTNISAVETEEVEPDEEEFQEESLVDDSLLQDDDEEEEDNESRSWRR

SEQ ID NO: 877366 - protein, 688 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAHKRGILS

SEQ ID NO: 877367 - protein, 791 aa, Homo sapiens; identical to SEQ ID NO: 877362

SEQ ID NO: 877368 - protein, 843 aa, Homo sapiens; identical to SEQ ID NO: 877364

SEQ ID NO: 877369 - protein, 254 aa, Homo sapiens
MLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 877370 - protein, 821 aa, Homo sapiens
SRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEQREIIIA

SEQ ID NO: 877371 - protein, 135 aa, Homo sapiens
MQEPEFGASHSYLSMAVGPPVACKQAVMEHVLAVFRHHAWRLAHILFFHPHHSIGHAPAFHCPFAKDILNTTTPKESCVSVLYVIKEKPPLSAERSHGYPHHPAPMKPENQLAQQGRPQSQERPKSKLQRASRSP

SEQ ID NO: 877372 - protein, 125 aa, Homo sapiens
CGWARARRSEEEPGAQTESARSLGGRSPRKIDQFCNSRNMVHGSVTFRDVAIDFSQEEWECLQPDQRTLYRDVMLENYSHLISLGSSISKPDVITLLEQEKEPWIVIWSQNMDLRKYLQKMIFLK

SEQ ID NO: 877373 - protein, 260 aa, Homo sapiens
GRRGHRPLGAGQRRAAGAQRTAWLGERTAMAPWLQLCSVFFTVNACLNGSQLAVAAGGSGRARGADTCGWREGEGGGFLAVANSRGTQRAQVLAGRRARANLSALRGVRGRPGSHSSRASSWFPSPDACPPALAEMKAAARPRLCVANEGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTVSHTGERAPE

SEQ ID NO: 877374 - protein, 142 aa, Homo sapiens
MGAEVNQMTATSHHEEWLKVCLDYRQSWPWQGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTVSHTGERAPE

SEQ ID NO: 877375 - protein, 415 aa, Homo sapiens
LHPCSWDTVPSGSNRPGVGGATGSAPWPWLPLLPGAARGEGDRWGRQVENWASELMAKAPSWAGVGALAYKAPEALWPAEAVMDGTMEDSEAVQRATALIEQRLAQEEENEKLRGDTRQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 877376 - protein, 125 aa, Homo sapiens
SLPPWSHALLCVEENSGRSVAPYWHFQCHPPPGMHFLRQNLSMKKHVLLSAEGSVLESGVRGPSRLPRMAGDSAVGLCPVASAVGTQGAAGVPSQRHPLDAHRAAASAECQLLHTVQLDLSDFLS

SEQ ID NO: 877377 - protein, 106 aa, Homo sapiens
TSSFWSLPAKKYRKVAGKEIYSDTLESTPMLEKEKFPQDYFPETQLPTGNEHRGSPGQMASPREEADMFGIRDKCLVQHAGSLPPRHPAIELPGSSGHGPMQQPDQ

SEQ ID NO: 877378 - protein, 67 aa, Homo sapiens
CMFYYFTLEHSSSAPPHHPVSNLPLQVTAVRCGICSWWKHRSVSLLWLPLSAVQHGVRPAGFSCWSF

SEQ ID NO: 877379 - protein, 422 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 877380 - protein, 412 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 877381 - protein, 107 aa, Homo sapiens
GRLDISFSLPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 877382 - protein, 105 aa, Homo sapiens
CAQGPSCLCWPSAPPSPVHGCPGETQGLGVQREAAACAVLSRVRRADTVLSSCCSPCSWPSESCPGQVNLMPMCTSVVSCSDVVVNMTPPSSSAFTQLFLVRLFL

SEQ ID NO: 877383 - protein, 221 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPETQLPTGNEHRGSPGQMASPREEADMFGIRDKCLVQHAGSLPPRHPAIELPGSSGHGPMQQPDQ

SEQ ID NO: 877384 - protein, 412 aa, Homo sapiens; identical to SEQ ID NO: 877380

SEQ ID NO: 877385 - protein, 118 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTGLIQMKKKNTTGGAAN

SEQ ID NO: 877386 - protein, 412 aa, Homo sapiens; identical to SEQ ID NO: 877380

SEQ ID NO: 877387 - protein, 412 aa, Homo sapiens; identical to SEQ ID NO: 877380

SEQ ID NO: 877388 - protein, 349 aa, Homo sapiens
MAGKAAAPGTAVLLVTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 877389 - protein, 317 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTARQCLCRSGVSGGRDSS

SEQ ID NO: 877390 - protein, 197 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPPSAHKELLECRHSATPSMPTELQPLQSVSSFTLSNLISAIFCHNT

SEQ ID NO: 877391 - protein, 77 aa, Homo sapiens
MDGRVQLMKALLAGPLRPAARRWRNPIPFPETFDGDTDRLPEFIVQTCSYMFVDENTFSNDALKTYAGLQHMPVPEL

SEQ ID NO: 877392 - protein, 164 aa, Homo sapiens
GGARASAWALPHGSAHSPSRPGPPPSTCASGDALALTPTQPSETPRSARGTMDGRVQLMKALLAGPLRPAARRWRNPIPFPETFDGDTDRLPEFIVQTCSYMFVDENTFSNDALKVTFLITRLTGPALQWVIPYIRKESPLLNDYRGFLAEMKRVFGWEEDEDF

SEQ ID NO: 877393 - protein, 164 aa, Homo sapiens; identical to SEQ ID NO: 877392

SEQ ID NO: 877394 - protein, 103 aa, Homo sapiens
MSWYGMCCEASETPRSARGTMDGRVQLMKALLAGPLRPAARRWRNPIPFPETFDGDTDRLPEFIVQTCSYMFVDENTFSNDALKTYATTAIAIHRISPTDCGS

SEQ ID NO: 877395 - protein, 134 aa, Homo sapiens
GGARASAWALPHGSAHSPSRPGPPPSTCASGDALALTPTQPSETPRSARGTMDGRVQLMKALLAGPLRPAARRWRNPIPFPETFDGDTDRLPEFIVQTCSYMFVDENTFSNDALKTYATTAIAIHRISPTDCGS

SEQ ID NO: 877396 - protein, 164 aa, Homo sapiens; identical to SEQ ID NO: 877392

SEQ ID NO: 877397 - protein, 170 aa, Homo sapiens
GGARASAWALPHGSAHSPSRPGPPPSTCASGDALALTPTQPSETPRSARGTMDGRVQLMKALLAGPLRPAARRWRNPIPFPETFDGDTDRLPEFIVQTCSYMFVDENTFSNDALKVQAGLLLHTGQTTHSRCCQPTSTPPDCQPTTSFCPQTYATTAIAIHRISPTDCGS

SEQ ID NO: 877398 - protein, 308 aa, Homo sapiens
SAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIK

SEQ ID NO: 877399 - protein, 77 aa, Homo sapiens
ALILDRMFCALGWPRLVVSPAPPPLQEVVSHCKKLTKRNKEQLSDMMVLDKQKGLKSLSKEKRQKLEAYQHLFYLLQ

SEQ ID NO: 877400 - protein, 455 aa, Homo sapiens
SAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIKSKVEQPQDVVTGNPTVVRLVVRFYRNGRGQSALQEILGKVIQDVLEDKVLSVHTDPVHLYKNWINQTEAQTGQRSHLPYDVTPEQALSHPEVQRRLDIALRNLLAMTDKFLLAITSSVDQIPYVQQPHPSLRMGFQEGQATMGSRAG

SEQ ID NO: 877401 - protein, 95 aa, Homo sapiens
SFLVNDCSLIHNNVCMAAVFVDRAGEWKLGGLDYMYSAQGNGGGPPRKGIPELEQYDPPELADSSGRVVREKWWVTGGSAPQPALSWRPLQPQDS

SEQ ID NO: 877402 - protein, 1115 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877403 - protein, 1270 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877404 - protein, 1115 aa, Homo sapiens; identical to SEQ ID NO: 877402

SEQ ID NO: 877405 - protein, 1115 aa, Homo sapiens; identical to SEQ ID NO: 877402

SEQ ID NO: 877406 - protein, 1097 aa, Homo sapiens
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877407 - protein, 1270 aa, Homo sapiens; identical to SEQ ID NO: 877403

SEQ ID NO: 877408 - protein, 1270 aa, Homo sapiens; identical to SEQ ID NO: 877403

SEQ ID NO: 877409 - protein, 742 aa, Homo sapiens
VGDRGLWVDRGLWVDRGLWVDRGLWVDRGIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877410 - protein, 536 aa, Homo sapiens
KHKTRARYEARVNSAEADVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877411 - protein, 488 aa, Homo sapiens
YGAPRRRDGAAGAARARQAGHARSAAGAQRDGSYARVPANQTGHRRCDGGPGPGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877412 - protein, 1046 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLIR

SEQ ID NO: 877413 - protein, 1270 aa, Homo sapiens; identical to SEQ ID NO: 877403

SEQ ID NO: 877414 - protein, 166 aa, Homo sapiens
MAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877415 - protein, 1260 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQGKLIWLNWGGGDKTFFSL

SEQ ID NO: 877416 - protein, 1112 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGVAI

SEQ ID NO: 877417 - protein, 1008 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRIYTVKKIYKVRINRLETTLM

SEQ ID NO: 877418 - protein, 621 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVLGREEL

SEQ ID NO: 877419 - protein, 1270 aa, Homo sapiens; identical to SEQ ID NO: 877403

SEQ ID NO: 877420 - protein, 1097 aa, Homo sapiens; identical to SEQ ID NO: 877406

SEQ ID NO: 877421 - protein, 1270 aa, Homo sapiens; identical to SEQ ID NO: 877403

SEQ ID NO: 877422 - protein, 1270 aa, Homo sapiens; identical to SEQ ID NO: 877403

SEQ ID NO: 877423 - protein, 824 aa, Homo sapiens
MQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877424 - protein, 815 aa, Homo sapiens
KARCEAGFNRPRRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877425 - protein, 1255 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQLGFFVLFLSKRDR

SEQ ID NO: 877426 - protein, 373 aa, Homo sapiens
KLARYEAGCARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 877427 - protein, 1270 aa, Homo sapiens; identical to SEQ ID NO: 877403

SEQ ID NO: 877428 - protein, 1273 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQYKLLEGLGLNCINHSSPSTNAALSRNSLKLL

SEQ ID NO: 877429 - protein, 1210 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHDWCAAELQSPSHEISFGYQVQNLQPSVHGITGCI

SEQ ID NO: 877430 - protein, 779 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAEIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKEKCTRQLNMKILVPNVWPMSFAKYRLLEDCGLSA

SEQ ID NO: 877431 - protein, 332 aa, Homo sapiens
VPISAAGLQGEQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAGIHASSPVSPPSFSLTPSAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWYIH

SEQ ID NO: 877432 - protein, 1316 aa, Homo sapiens
MVRATAKGHGNLERELGELTVGYGGQRKPAGKIWGTEEGLLREGQESSEELLCDLGSDFDMGVPGAIISLPGALIPCIVSLVKSEQPGRALVQTWAEMTVMRGGLAFLGDNVPHICMSPGWQRARAERDWTWDQQARQVLSWSWPHVFAVGPQTKPCTSLSLGCLGAAGSSVGPPHSSFLPLLSPGSRGCERIIWGRPSTSKQADGGGHLRPNEYLDQVGNKNTRRGGNQKSLEKDLAQLPLWETEAQLGEGQDHAGRKSRLPLATAKYFVPYSPPQGGGTEEKTKAQQGGVLKAVTGGGGAGTRAPDPQPMVFPVTLVYPHLLFLRRVDSKSSERWFWAPCPRQSVCKNCQGSLVTQARDGAQRAHSRHMHPRPHPEPAGQRREVVGARVHLQEPGGAGCSFHLSGKVGEGMLPGISLPASLHLAGSGGVRGLQHRLLEPLPPVTLLLEMMCTHIFGSCPPCGSRLLGGGQPPLNQLPEACSILPRQSPPGSQRPPLPILFLFLPCNELPPYLSSLTCGFAGPQIGFVFVRQPLDSWAARRKHKRTWMHTDVLTHTRPLSPIHSTSWSSGAAWELGEDGSKGHKPLSRCQRILNGKHKSGASPASWQKAWGISPWAFFPVFEALTFGKGHCGFYENFSYHQSSSNLEKLDDISNPTSLSQGTLVKASPSITDIVRCFAILNHSVEQRADAYFIDGEIDIWGSHGNIEAEVNSQISRPHSLSTELCSCHGSVWLKDTPPPPFPRNPPDPQSGKKEQGPRGWPDLGACRLAALFPKNIETCGVFDQIHKVLLRFHPDSFPAVPEVQRVSESIQGHAIIPDQAGHGSSPDSRGPGAKVMCCPPLPFLCLPTLEQAPGLAVTVCRSAQARATRVSTAPGNTDHNLKSPEMNCFLGERGGVALPLGQRTRQYGAAVPEMPRSVPAPLSGIQVCKLVKFSVGLKKNVHGPNLTHWAPACEPQCLSIAPFLIHLLSFVADLEEMGAQRGERCASGCPAKAGVETGTPRACHSPRPHLGLLQALRFEDGVGWKVRGAGDGIGELLGFQEEVSAAWAPFTCAGKRLRCGHRALRGEIHLPEVTLQNDCPALAASGSSHPLLMTFSQNGAPSQEANLKNQPSTLTQPRNTMSLKYSFPGGESKIQLPGRVETNSCPTARPGPGRHGWIPQGSELDRLHGGPTTRPVLQSWPCHPSRGCSDGSQPHTSSPGETISFVLLASERSEASTFLKKVIKCIIGKLDSQATTPSPRRAPPPSSPFSPLPLLPQTSGFPLAYSWGNHSADVHFPTVSSAAPRVAPGPKGLCRGQAVSPLPACSPDEATASLK

SEQ ID NO: 877433 - protein, 1316 aa, Homo sapiens; identical to SEQ ID NO: 877432

SEQ ID NO: 877434 - protein, 151 aa, Homo sapiens
HEEKAHGEMPQAFCHDAGEAPDLCFPSCSSSCPVMSSPHTFPPSPGGFAGPQIGFVFVRQPLDSWAARRKHKRTWMHTDVLTHTRPLSPIHSTSWSSGAAWELGEDGSKGHKPLSRCQRILNGKHKSGASPASWQKAWGISPWAFFPVFEL

SEQ ID NO: 877435 - protein, 1316 aa, Homo sapiens; identical to SEQ ID NO: 877432

SEQ ID NO: 877436 - protein, 1280 aa, Homo sapiens
MCTHIFGSCPPCGSRLLGGGQPPLNQLPEACSILPRQSPPGSQRPPLPILFLFLPCNELPPYLSSLTCGFAGPQIGFVFVRQPLDSWAARRKHKRTWMHTDVLTHTRPLSPIHSTSWSSGAAWELGEDGSKGHKPLSRCQRILNGKHKSGASPASWQKAWGISPWAFFPVFEALTFGKGHCGFYENFSYHQSSSNLEKLDDISNPTSLSQGTLVKASPSITDIVRCFAILNHSVEQRAYAYFIDGEIDIWGSHGNIEAEVNSQISRPHSLSTELCSCHGSVWLKDTPPPPFPRNPPDPQSGKKEQGPRGWPDLGACRLAALFPKNIEPAESLTKSTTVLLRFHPDSFPAVPEVQRVSESIQGHAIIPDQAWTWVQPWLQGSRCQGHVLSPTSLSLPSHFGTGSRPGCDSMQECPSQGHQGVHSPWKHRSQSQVPLMNCFLGERGGVALPLGQRTRQYGAAVPEMPRSVPAPLSGIQVGKLVKFSVGLKKNVHGPNLTHWAPACEPQCLSIAPFLIHLLSFVADLEEMGAQRGERCASGCPAKAGVETGTPRACHSPRPHLGLLQALRFEDGVGWKVRGAGDGIGELLGFQEEVSAAWAPFTCAGKRLRCGHRALRGEIHLPEVTLQNDCPALAASGSSHPLLMTFSQNGAPSQEANLKNQPSTLTQPRNTMSLKYSFPGGESKIQLPGRVETNSCPTARPGPGRHGWIPQGSELDRLHGGPTTRPVLQSWPCHPSRGCSDGSQPHTSSPGETISFVLLASERSEASTFLKKVIKCIIGKLDSQATTPSPRRAPPPSSPFSPLPLLPQTSGFPLAYSWGNHSADVHFPTVSSAAPRVAPGPKGLCRGQAVSPLPACSPDEANSFSEMSCRPGAGRHQPVFPFLVIPQPEAPFLGTPGLKGTSESCHCHSRVSIQGVPFSSSPRWVNVATIQKAQKFLFPHLRPLSNTRRKCSCLPINIYSGTISKASKESSQVGYLACGRRDRGTNPPTISFRWLIGAQGGKQVKQQGGGDLAVMHLLPDSEAWQEEATPASPALTPAPHPVTLWLWPLVALVPKITMPVATSLIFSKSIIEEQVILDDGFLIYKRRISLGVEQKGNHLMAPFFSSMNTFNETILLYLRKWRVEHSNQINSQLIAIKLKRKEINPESILNTAKSSEPQNLAFPSHKVHEHVNTHTHTHTHTHTLTHSPTPQTYLKLRNSTESPHANSCLLSSTWVREGEQTRQQPVPGLRKRQAHPLAPSTQHNRGWRAVRAWRCLGPTSQPQLLGLQGWAEDGVLALGLP

SEQ ID NO: 877437 - protein, 520 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877438 - protein, 520 aa, Homo sapiens; identical to SEQ ID NO: 877437

SEQ ID NO: 877439 - protein, 520 aa, Homo sapiens; identical to SEQ ID NO: 877437

SEQ ID NO: 877440 - protein, 475 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVGKYINPAATKRAAEEEPSTSATVPMSKKKPSRGFGDFSSW

SEQ ID NO: 877441 - protein, 583 aa, Homo sapiens
NSAAAPWSELSAVVFSCSLVAAAAPPWGSDSTKRTKCTLPVLNTLTFMVARSQFIRNKKNDNIFSCQNYQDYNNKSTVIILMEVKSMHFSNLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877442 - protein, 512 aa, Homo sapiens
MYITCAEYTSSYYWLAMNDHLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877443 - protein, 520 aa, Homo sapiens; identical to SEQ ID NO: 877437

SEQ ID NO: 877444 - protein, 549 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGRCCRPEAKALLPRLSEPRARSPVGAAFAGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877445 - protein, 520 aa, Homo sapiens; identical to SEQ ID NO: 877437

SEQ ID NO: 877446 - protein, 520 aa, Homo sapiens; identical to SEQ ID NO: 877437

SEQ ID NO: 877447 - protein, 520 aa, Homo sapiens; identical to SEQ ID NO: 877437

SEQ ID NO: 877448 - protein, 520 aa, Homo sapiens; identical to SEQ ID NO: 877437

SEQ ID NO: 877449 - protein, 208 aa, Homo sapiens
GLQEFGTSGPAEEGHSEDTVTAQVSTHLEASEASRVQVRVVGMKACPGREKQVWRGPCAHPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877450 - protein, 520 aa, Homo sapiens; identical to SEQ ID NO: 877437

SEQ ID NO: 877451 - protein, 248 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAVSGGGHSAKP

SEQ ID NO: 877452 - protein, 219 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDSEGLENQSPCQCLHGYRALFCGDVYQLLHIRYDA

SEQ ID NO: 877453 - protein, 300 aa, Homo sapiens
LASSESLLPWPPKVLELQAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877454 - protein, 175 aa, Homo sapiens
MGKRQHQKDKMNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHASRAKKTKNKKKKKNPGSFPGRKKVKRQGKVFRPFWKRGKTGPKKGENQNRRTK

SEQ ID NO: 877455 - protein, 520 aa, Homo sapiens; identical to SEQ ID NO: 877437

SEQ ID NO: 877456 - protein, 452 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQVRGHDATT

SEQ ID NO: 877457 - protein, 502 aa, Homo sapiens
MEVKSSTFPNLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877458 - protein, 502 aa, Homo sapiens
MEEKVCTFPNLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877459 - protein, 529 aa, Homo sapiens
NSAAAPWSELSAVVFSCSLVAAAAPPWGSDSTKRTKYLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877460 - protein, 489 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAAT

SEQ ID NO: 877461 - protein, 380 aa, Homo sapiens
EQVGRRIIFFFRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 877462 - protein, 520 aa, Homo sapiens; identical to SEQ ID NO: 877437

SEQ ID NO: 877463 - protein, 480 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGKAGLERTLCPP

SEQ ID NO: 877464 - protein, 208 aa, Homo sapiens; identical to SEQ ID NO: 877449

SEQ ID NO: 877465 - protein, 520 aa, Homo sapiens; identical to SEQ ID NO: 877437

SEQ ID NO: 877466 - protein, 211 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAQVNTTVWPP

SEQ ID NO: 877467 - protein, 68 aa, Homo sapiens [sequence omitted]

SEQ ID NO: 877468 - protein, 154 aa, Homo sapiens
AATRAGGGRVRRGRARPSLASWLASSARRLPGTPRGHALRARPRPHPHLPSCGTGFRPGPRPLAGATQAARDVAALPGLVGGSWGSGSSGRNTAMTAPVARVTLPRAAVGAQEPFHFTARLSSGSSSEQKVSRSLFATSYNIETDSVPFKGDNN

SEQ ID NO: 877469 - protein, 145 aa, Homo sapiens
TETGSREIRTHLHLQSQVPSRDDLHNNLRVLVVEKLREEKTSRTVSNRPQARRSSINATTITLRLEYNGTISARRNLHLLGSSDSPASASRVAGITGSKSLLRPLKHGTIPNEVNGSSMTGWKYKCQHLCESQEGKLETKRKKRT

SEQ ID NO: 877470 - protein, 154 aa, Homo sapiens; identical to SEQ ID NO: 877468

SEQ ID NO: 877471 - protein, 154 aa, Homo sapiens; identical to SEQ ID NO: 877468

SEQ ID NO: 877472 - protein, 154 aa, Homo sapiens; identical to SEQ ID NO: 877468

SEQ ID NO: 877473 - protein, 169 aa, Homo sapiens
TLAVVSEPLRFQALGGEGQSADLRPLLTDFRLQFICAPASSLSLRRLRLRPQKEISILCPEQNRMAMSQESLTFKDVFVDFTLEEWQQLDSAQKNLYRDVMLENYSHLVSVGYLVAKPDVIFRLGPGEESWMADGGTPVRTCAGEEYSPSEIPAESLWYLTRPIITGGI

SEQ ID NO: 877474 - protein, 226 aa, Homo sapiens
SHLVSVGYLVAKPDVIFRLWGVNGQSADLRPLLTDFRLQFICAPASSLSLRRLRLRPQKEISILCPEQNRMAMSQESLTFKDVFVDFTLEEWQQLDSAQKNLYRDVMLENYSHLVSVGYLVAKPDVIFRLGPGEESWMADGGTPVRTCAGEEDRVSPCCPDWSQTPGFKQSTRLGLPKCWDYRSVTTNRGTRHAAPALEKQRCGGNLSHSQSLGLDLLPTTAVQFC

SEQ ID NO: 877475 - protein, 247 aa, Homo sapiens
TLAVVSEPLRFQALGGEGQSADLRPLLTDFRLQFICAPASSLSLRRLRLRPQKEISILCPEQNRMAMSQESLTFKDVFVDFTLEEWQQLDSAQKNLYRDVMLENYSHLVSVGYLVAKPDVIFRLGPGEESWMADGGTPVRTCAGEECIHFCLMYFEVLLLEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 877476 - protein, 150 aa, Homo sapiens
TLAVVSEPLRFQALGGEGQSADLRPLLTDFRLQFICAPASSLSLRRLRLRPQKEISILCPEQNRMAMSQESLTFKDVFVDFTLEEWQQLDSAQKNLYRDVMLENYSHLVSVGYLVAKPDVIFRLGPGEESWMADGGTPVRTCAGEESLAS

SEQ ID NO: 877477 - protein, 115 aa, Homo sapiens
YFTGGGDPGTDLCRCIHFCLMYFEVLLLEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 877478 - protein, 293 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 877479 - protein, 293 aa, Homo sapiens; identical to SEQ ID NO: 877478

SEQ ID NO: 877480 - protein, 293 aa, Homo sapiens; identical to SEQ ID NO: 877478

SEQ ID NO: 877481 - protein, 293 aa, Homo sapiens; identical to SEQ ID NO: 877478

SEQ ID NO: 877482 - protein, 293 aa, Homo sapiens; identical to SEQ ID NO: 877478

SEQ ID NO: 877483 - protein, 293 aa, Homo sapiens; identical to SEQ ID NO: 877478

SEQ ID NO: 877484 - protein, 266 aa, Homo sapiens
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 877485 - protein, 266 aa, Homo sapiens; identical to SEQ ID NO: 877484

SEQ ID NO: 877486 - protein, 325 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLKLGSPGFRGYIGEGLLADDSLQGPEVAQAIIMEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 877487 - protein, 130 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLSQA

SEQ ID NO: 877488 - protein, 293 aa, Homo sapiens; identical to SEQ ID NO: 877478

SEQ ID NO: 877489 - protein, 293 aa, Homo sapiens; identical to SEQ ID NO: 877478

SEQ ID NO: 877490 - protein, 293 aa, Homo sapiens; identical to SEQ ID NO: 877478

SEQ ID NO: 877491 - protein, 266 aa, Homo sapiens; identical to SEQ ID NO: 877484

SEQ ID NO: 877492 - protein, 266 aa, Homo sapiens; identical to SEQ ID NO: 877484

SEQ ID NO: 877493 - protein, 247 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 877494 - protein, 627 aa, Homo sapiens
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 877495 - protein, 120 aa, Homo sapiens
SGPLCRSLVRTEQGSRIGIPAAPLYEPDPFRGFVPGSPSSCGLSSPALQPRGLQGRRPGSGTRLPPRRRRPCVWNAVATEEAAAPSAPGSPGQPARVGHRWGPSGRPGLLCPSSAAQGVT

SEQ ID NO: 877496 - protein, 554 aa, Homo sapiens
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 877497 - protein, 585 aa, Homo sapiens
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 877498 - protein, 511 aa, Homo sapiens
MFGTESSVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 877499 - protein, 229 aa, Homo sapiens
LRLHVFPELSTDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 877500 - protein, 209 aa, Homo sapiens
MFWLQLLSSGILQLVAAWGTSTNWSWAVGVISTAYHQDKQRSYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 877501 - protein, 402 aa, Homo sapiens
MQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHIPMRCNKNSCSDTRFCCLFLFPDFLQPSPFRA

SEQ ID NO: 877502 - protein, 342 aa, Homo sapiens
MQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAVSVCLEGG

SEQ ID NO: 877503 - protein, 534 aa, Homo sapiens
MFGTESSVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 877504 - protein, 365 aa, Homo sapiens
MQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAFLSTLFAPLNFVMEKVESILPSSLWHQLTRI

SEQ ID NO: 877505 - protein, 338 aa, Homo sapiens
MQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSMLALLTHQFPELMGVFAKAFLSTLFAPLNFVMEKVESILPSSLWHQLTRI

SEQ ID NO: 877506 - protein, 373 aa, Homo sapiens
MQKAWRERNPQARISAAHEALEINECATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 877507 - protein, 261 aa, Homo sapiens
SRPIGSRLRRRGGKCGYMSRRQSQSALSLVPVVQPAARAGMWAGGRSSCQAEVLRATRGGAARGNAAPGRALEMVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 877508 - protein, 140 aa, Homo sapiens
SRPIGSRLRRRGGKCGYMSRRQSQSALSLVPVVQPAARAGMWAGGRSSCQAEVLRATRGGAARGNAAPGRALEMVPGAAGWCCLVLWLPACVAAHGFRIHDYLYFQVLSPGDIRYIFTATPAKGVSCYKKRQETGPRASG

SEQ ID NO: 877509 - protein, 181 aa, Homo sapiens
GGREVQAPVVFLLVPLFRHGPNQDNALQGGVWAIRKSPATLPKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 877510 - protein, 76 aa, Homo sapiens
SGEGGARTCLSFGLITTSSRGCSFLSKTRVVQEHGGRAVIISDNAVDNDSFYVEMIQDSTQRTADIPALFLLGRDG

SEQ ID NO: 877511 - protein, 261 aa, Homo sapiens; identical to SEQ ID NO: 877507

SEQ ID NO: 877512 - protein, 177 aa, Homo sapiens
SRPIGSRLRRRGGKCGYMSRRQSQSALSLVPVVQPAARAGMWAGGRSSCQAEVLRATRGGAARGNAAPGRALEMVPGAAGWCCLVLWLPACVAAHGFRIHDYLYFQVLSPGDIRYIFTATPAKDFGGIFHTRYEQIHLVPAEPPEACGELSNGFFIQDQIALVERGLGWSRSTAGGR

SEQ ID NO: 877513 - protein, 120 aa, Homo sapiens
VLRAKMANWFHQAKQAQTIATQDGSLISPGPPMRQANEIFTWTHHHQHFKKTVVWMIKTIYHPSQPAPFQKKEHVSAPTPTKKSDCFKTGTVRWANFLNVSQIFLFISSYKRCFPQIPRY

SEQ ID NO: 877514 - protein, 1171 aa, Homo sapiens
MENNLKTCPKEDGDFVSDKIKFKIEEEDDDGIPPDSLERMDFKSEQEDMKQTDSGGERAGLGGTGCSCKPPGKYLSAESEDDYGALFSQYSSTLYDVAMEAVTQSLLSSRNMSSRKKSPAWKHFFISPRDSTKAICMYCVKEFSRGKNEKDLSTSCLMRHVRRAHPTVLIQENGSVSAVSSFPSPSLLLPPQPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDVGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 877515 - protein, 1008 aa, Homo sapiens
AEQARKAAEWEGWSTVAGCPCPRSPATRWPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDVGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 877516 - protein, 628 aa, Homo sapiens
KLVRAGLKFGRGLIEVYSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 877517 - protein, 1171 aa, Homo sapiens; identical to SEQ ID NO: 877514

SEQ ID NO: 877518 - protein, 822 aa, Homo sapiens
MLSRAGFNLAEACRRVKGELSSVSSSPVKPVRESPSASSSPDRLTEDLQSHLNPGDGLMEDVAAFSSSDDVGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 877519 - protein, 1171 aa, Homo sapiens; identical to SEQ ID NO: 877514

SEQ ID NO: 877520 - protein, 1177 aa, Homo sapiens
MENNLKTCPKEDGDFVSDKIKFKIEEEDDDGIPPDSLERMDFKSEQEDMKQTDSGGERAGLGGTGCSCKPPGKYLSAESEDDYGALFSQYSSTLYDVAMEAVTQSLLSSRNMSSRKKSPAWKHFFISPRDSTKAICMYCVKEFSRGKNEKDLSTSCLMRHVRRAHPTVLIQENGSVSAVSSFPSPSLLLPPQPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDVGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPIGQRRGCPSVSSPEGLPWPQPLCTLFLVSSYPVAVRLFP

SEQ ID NO: 877521 - protein, 837 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 877522 - protein, 196 aa, Homo sapiens
MATSEILPSFVATMDASNFSFWQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 877523 - protein, 837 aa, Homo sapiens; identical to SEQ ID NO: 877521

SEQ ID NO: 877524 - protein, 837 aa, Homo sapiens; identical to SEQ ID NO: 877521

SEQ ID NO: 877525 - protein, 721 aa, Homo sapiens [sequence omitted]

SEQ ID NO: 877526 - protein, 515 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWLLGSIHGQKHSAQAGDVSW

SEQ ID NO: 877527 - protein, 721 aa, Homo sapiens [sequence omitted]

SEQ ID NO: 877528 - protein, 667 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 877529 - protein, 837 aa, Homo sapiens; identical to SEQ ID NO: 877521

SEQ ID NO: 877530 - protein, 837 aa, Homo sapiens; identical to SEQ ID NO: 877521

SEQ ID NO: 877531 - protein, 772 aa, Homo sapiens
LTGADEVDWRRVVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 877532 - protein, 490 aa, Homo sapiens
MVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 877533 - protein, 791 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAAAAVQRVVARDLGGLGADQGDLATLRSVAAGEA

SEQ ID NO: 877534 - protein, 128 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTSLIDMAK

SEQ ID NO: 877535 - protein, 920 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 877536 - protein, 569 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVVDVALNQPDMCVYRRGRKKRVPYTKLQLKELENEYAINKFINKDKRRRISAATNLSERQVTIWFQNRRVKDKKIVSKLKDTVS

SEQ ID NO: 877537 - protein, 1695 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQGAFQ

SEQ ID NO: 877538 - protein, 1817 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877539 - protein, 1359 aa, Homo sapiens
NILVCTPGRLLQHMDETVSFHATDLQMLALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877540 - protein, 1071 aa, Homo sapiens
MDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877541 - protein, 1621 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDSIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQGAFQ

SEQ ID NO: 877542 - protein, 1723 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVNLVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877543 - protein, 1644 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASGGLLR

SEQ ID NO: 877544 - protein, 1621 aa, Homo sapiens; identical to SEQ ID NO: 877541

SEQ ID NO: 877545 - protein, 441 aa, Homo sapiens [sequence omitted]

SEQ ID NO: 877546 - protein, 299 aa, Homo sapiens
MYCFIKLFLQNTSDSDRYACSPLPSYLEGSGCVIAEEQNSQTPLRDVCFHLLKLYSDSIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877547 - protein, 129 aa, Homo sapiens
AGITGVSHSACPPLAFCIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877548 - protein, 1800 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877549 - protein, 1495 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQVYVANRAKQKSCWVLKYCQIEAEPGNLMGNYPLLLPLDKATSPSVCFYFIKYHEIPQL

SEQ ID NO: 877550 - protein, 992 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLAPKHFPPSIYPFQKQKQTMTEAGMELGVRGRQRAFATLLTAIGSPR

SEQ ID NO: 877551 - protein, 1171 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKP

SEQ ID NO: 877552 - protein, 549 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVVLDEADRILDMGFADTMNAVIENLPKKRQTLLFSATQTKSVKDLARLSLKNPEYVWVHEKAKYSTPATLEQNYIVCELQQ

SEQ ID NO: 877553 - protein, 428 aa, Homo sapiens [sequence omitted]

SEQ ID NO: 877554 - protein, 67 aa, Homo sapiens
ELRLEDYQANRKGPQNQVGAGTTTGLFGSSPATSSATGLFSSSTTNSGFAYGQNKTAFGTSKHLISC

SEQ ID NO: 877555 - protein, 937 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 877556 - protein, 1800 aa, Homo sapiens; identical to SEQ ID NO: 877548

SEQ ID NO: 877557 - protein, 1753 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877558 - protein, 1697 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSCLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 877559 - protein, 1800 aa, Homo sapiens; identical to SEQ ID NO: 877548

SEQ ID NO: 877560 - protein, 441 aa, Homo sapiens [sequence omitted]

SEQ ID NO: 877561 - protein, 1697 aa, Homo sapiens; identical to SEQ ID NO: 877558

SEQ ID NO: 877562 - protein, 1800 aa, Homo sapiens; identical to SEQ ID NO: 877548

SEQ ID NO: 877563 - protein, 1360 aa, Homo sapiens [sequence omitted]

SEQ ID NO: 877564 - protein, 593 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPNTPATLEQNYIVCELQQ

SEQ ID NO: 877565 - protein, 540 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVVDREKQPSEGAFSENNAENESGGDKPPIDPNNPAANWLHARSTRKKRCPYTKHQTLELEKEFLFNMYLTRD

SEQ ID NO: 877566 - protein, 418 aa, Homo sapiens [sequence omitted]

SEQ ID NO: 877567 - protein, 79 aa, Homo sapiens
PAISLRNFGRVRGTPRPPHLLRFRAEEGGDPEAAARIEEESAESGDEALEALRSRLPPPGFPHPLPSFPPVPGPASQLY

SEQ ID NO: 877568 - protein, 1433 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 877569 - protein, 175 aa, Homo sapiens
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITDDEATRTFIEAYKMQWDLRASKANVHLAKIITPGDTGDD

SEQ ID NO: 877570 - protein, 785 aa, Homo sapiens
MDSVPATVPSIAATPGDPELVGPLSVLYAAFIAKLLELVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 877571 - protein, 1288 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNAPILNN

SEQ ID NO: 877572 - protein, 889 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQQ

SEQ ID NO: 877573 - protein, 1433 aa, Homo sapiens; identical to SEQ ID NO: 877568

SEQ ID NO: 877574 - protein, 1433 aa, Homo sapiens; identical to SEQ ID NO: 877568

SEQ ID NO: 877575 - protein, 1348 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFDKDGRPGTVAHACNPSTL

SEQ ID NO: 877576 - protein, 1285 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPRIWQLPMMNHSRKLLSPYQGYLRWKGQGNY

SEQ ID NO: 877577 - protein, 355 aa, Homo sapiens
MKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWREYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 877578 - protein, 282 aa, Homo sapiens
MDSVPATVPSIAATPGDPELVGPLSVLYAAFIAKLLELVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKKGENFLFFFWGGGGG

SEQ ID NO: 877579 - protein, 689 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSVSLT

SEQ ID NO: 877580 - protein, 75 aa, Homo sapiens
KNRGPSAIPQGIVACVQLFYTMDSVPATVPSIAATPGDPELVGPLSVLYAAFIAKLLEVTVPIPGEGPKLSQAGG

SEQ ID NO: 877581 - protein, 1433 aa, Homo sapiens; identical to SEQ ID NO: 877568

SEQ ID NO: 877582 - protein, 1118 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 877583 - protein, 46 aa, Homo sapiens
MSEDGCFSVISPATSPESQAIGSPPFTLVSIDPWTVDQKSPSSALK

SEQ ID NO: 877584 - protein, 1275 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSGKGARVFKESKTMQEVGRGFFF

SEQ ID NO: 877585 - protein, 778 aa, Homo sapiens
MDSVPATVPSIAATPGDPELVGPLSVLYAAFIAKLLELVATLPDDVQPGPDFYGLPWKPVFITAFLGIASFAIFLWRTVLVVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 877586 - protein, 72 aa, Homo sapiens
AAAYYYYKSAAASIFFLILLTEYTSQNKSTSVLWSLTDPGSGTATMMNSSSRGSSPTRVLDEGKVNAPILNN

SEQ ID NO: 877587 - protein, 1433 aa, Homo sapiens; identical to SEQ ID NO: 877568

SEQ ID NO: 877588 - protein, 1275 aa, Homo sapiens; identical to SEQ ID NO: 877584

SEQ ID NO: 877589 - protein, 411 aa, Homo sapiens
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWREYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 877590 - protein, 324 aa, Homo sapiens
KNSILLGTWNLSLQCISPLEDFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWREYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 877591 - protein, 807 aa, Homo sapiens
KRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHGNTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLSSRGHFASR

SEQ ID NO: 877592 - protein, 72 aa, Homo sapiens
LPNRAPRQAQLWVQHVHVALYVCSSSAGKPWGGRRKGQIWKHADSLSPKNETLHHLETTCRGPRWAPGTTWY

SEQ ID NO: 877593 - protein, 136 aa, Homo sapiens
AHSLRRELNDSRAPAALPARPPLPPRDERGKPLWELGLRWREEGSYWSWPAALVLESPGEAEGRARFGSMQTAFPPRMRLSTTWKQLAEGQDGVLFLLPRLEYSGAVLAQCNLHLLSSSNSPASASQVVGIKGTRH

SEQ ID NO: 877594 - protein, 401 aa, Homo sapiens
LLLLLNSRPSTFFFQFSSIFIIHSRGHASGLSCPHLFPAPEVGTAADSSLGTRQLTDTAASPNSSGMGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 877595 - protein, 109 aa, Homo sapiens
LLLLLNSRPSTFFFQFSSIFIIHSRGHASGGPLSCLPCLSQALRWGKTGSLLCCSDLPEPKVREGQPTAPGGYGSSGAFGTLGQGCFLLRPSCSPGGQRETGLLPNTCL

SEQ ID NO: 877596 - protein, 335 aa, Homo sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 877597 - protein, 335 aa, Homo sapiens; identical to SEQ ID NO: 877596

SEQ ID NO: 877598 - protein, 162 aa, Homo sapiens [sequence omitted]

SEQ ID NO: 877599 - protein, 119 aa, Homo sapiens
VVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINP

SEQ ID NO: 877600 - protein, 87 aa, Homo sapiens
VVIHEKKVSSFEVFLKEVTGGVQAPFGAVRNIYTPRTGHRIRKLDQIQSGGNYVAGGQEAFKKLNYLDIGEIKKRPMEVVNTELHVL

SEQ ID NO: 877601 - protein, 87 aa, Homo sapiens
RSSGQSACGGRAHGPAGRAGSGRRDEEGRRRAASKDVPRDPRHLPVDFLAGKDVAVPVTCGDTADLPSTDGEKKITLPNVGGSNLVN

SEQ ID NO: 877602 - protein, 70 aa, Homo sapiens
RPLRPHLSLRLAMNSGMETVSISTKSALPNSRLSCSAMAPARGLRIIADVLSMGPFFLHPPNNYCTTLHI

SEQ ID NO: 877603 - protein, 79 aa, Homo sapiens
MSNGAAAVESSLGFLHGSMWSYRPSNSTSGRAPEGMENRCPNKNKHTNTQGSTISSGLKQEQPPRSPLMNGYTPCGGSA

SEQ ID NO: 877604 - protein, 141 aa, Homo sapiens
RARARRCPEARSRGGVAAMATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 877605 - protein, 141 aa, Homo sapiens; identical to SEQ ID NO: 877604

SEQ ID NO: 877606 - protein, 103 aa, Homo sapiens
MATAAGATYFQRGSLFWFTVITLSFGYYTWVVFWPQSIPYQNLGPLGPFTQYLVDHHHTLLCNGYWLAWLIHVGESLYAIVLCKQNELRIRIKMRKLILRDSE

SEQ ID NO: 877607 - protein, 171 aa, Homo sapiens
MATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQTFFLWGRGGAVIYSVIFLLSRNCPSKLFKTPSLVSFFSYMLWLSLNRPVVT

SEQ ID NO: 877608 - protein, 159 aa, Homo sapiens
GNGACAHAHLTVVSVTHWVVFWPQSIPYQNLGPLGPFTQYLVDHHHTLLCNGYWLAWLIHVGESLYAIVLCKHKGITSGRAQLLWFLQTFFFGIASLTILIAYKRKRQTFFLWGRGGAVIYSVIFLLSRNCPSKLFKTPSLVSFFSYMLWLSLNRPVVT

SEQ ID NO: 877609 - protein, 141 aa, Homo sapiens; identical to SEQ ID NO: 877604

SEQ ID NO: 877610 - protein, 143 aa, Homo sapiens
TAGELPANSVSGFFKRMVKSEASNAATAYFRPARPLPSLVTVLGLGYFAWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 877611 - protein, 111 aa, Homo sapiens
GNGACAHAHLTVVSVTHWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 877612 - protein, 84 aa, Homo sapiens
GNGACAHAHLTVVSVTHWVVFWPQSIPYQNLGPLGPFTQYLVDHHHTLLCNGYWLAWLIHVGESLYAIVLCKQNELRIRIKVCE

SEQ ID NO: 877613 - protein, 102 aa, Homo sapiens
RARARRCPEARSRGGVAAMATAAGATYFQRGSLFWFTVITLSFGYYTWVVFWPQSIPYQNLGPLGPFTQYLVDHHHTLLCNGYWLAWLIHVGESLYAIVLCK

SEQ ID NO: 877614 - protein, 95 aa, Homo sapiens
RDTYCIQGLCSLVTSAMPTPVPSCTTWFDFCPSSTAYTEPGAPGPRSRITWCTNITPVSVHRGLGLDLVVFHDGTVPLCHEYRGTHVDACNTDYR

SEQ ID NO: 877615 - protein, 141 aa, Homo sapiens; identical to SEQ ID NO: 877604

SEQ ID NO: 877616 - protein, 141 aa, Homo sapiens; identical to SEQ ID NO: 877604

SEQ ID NO: 877617 - protein, 105 aa, Homo sapiens
MSTNLPILPSFFFFFVLFSNDLDVPVGHIVHTGMLNEGGGYENDCSIARLNKRSFFMISPTDQQVHCWAWLKKQSLAGEESQRSDREATGYNRFVNSAKHSGGRA

SEQ ID NO: 877618 - protein, 183 aa, Homo sapiens
MEKPLEFERPQVRLFPPDQGLESPPIFQFCRLFFFVFVLFSNDLDVPVGHIVHTGMLNEGGGYENDCSIARLNKRSFFMISPTDQQVHCWAWLKKHMPKDSNLLLEDVTWKYFALNLIGPRAVDVLSELSYAPMTPDHFPSLFCKEMSVGYANGIRVMSMTHTGEPGFMLYIPIEGNEMLFHK

SEQ ID NO: 877619 - protein, 194 aa, Homo sapiens
AQTCPGLPPCSTLMLCGSVPGTLPGRQKGDEELKNQHRDANLAGTSCLFSGHSSLISQPPSLPFQSDKRVPGCPLLTLIHTWCPETFPHTFQPASPPSSVAPWAAWEVGKGLHLLLEDVTWKYTALNLIGPRAVDVLSELSYAPMTPDHFPSLFCKEMSVGYANGIRVMSMTHTGEPGFMLYIPIEGNEMLFHK

SEQ ID NO: 877620 - protein, 280 aa, Homo sapiens
MEKPLEFERPQVRLFPPDQGLESPPIFQFCRLFFFVFVLFSNDLDVPVGHIVHTGMLNEGGGYENDCSIARLNKRSFFMISPTDQQVHCWAWLKKHMPKDSNLLLEDVTWKYFALNLIGPRAVDVLSELSYAPMTPDHFPSLFCKEMSVGYANGIRVMSMTHTGEPGFMLYIPIEMGLHHVVHACLQLLTSSGPHTSASQSAGITGMSHCAWPQAAGVQWQDLGSPQPPPPRFKQFCLSLLSSWDNRHAPPCLANFVFLVETRFHYGGHWSGWSRTPDLR

SEQ ID NO: 877621 - protein, 116 aa, Homo sapiens
MSSFTEFEITTTGDQALEVLQYLFSNDLDVPVGHIVHTGMLNEGGGYENDCSIARLNKRSFFMISPTDQQVHCWAWLKKHMPKDSNLLLEDVTWKYFGLSNPCFSIHLAPCASSRS

SEQ ID NO: 877622 - protein, 167 aa, Homo sapiens
MSSFTEFEITTTGDQALEVLQYLFSNDLDVPVGHIVHTGMLNEGGGYENDCSIARLNKRSFFMISPTDQQVHCWAWLKKHMPKDSNLLLEDVTWKYFALNLIGPRAVDVLSELSYAPMTPDHFPSLFCKEMSVGYANGIRVMSMTHTGEPGFMLYIPIEGNEMLFHK

SEQ ID NO: 877623 - protein, 272 aa, Homo sapiens
MEKPLEFERPQVRLFPPDQGLESPPIFQFCRLFFFVFVLFSNDLDVPVGHIVHTGMLNEGGGYENDCSIARLNKRSFFMISPTDQQVHCWAWLKKHMPKDSNLLLEDVTWKYFALNLIGPRAVDVLSELSYAPMTPDHFPSLFCKEMSVGYANGIRVMSMTHTGEPGFMLYIPIEYALHVYNEVMSVGQKYGIRNAGYYALRSLRIEKLMPSGVKDINNLTTPLECGRESRVKLEKGMDFIGRDALLQQKQNGVYKRLTMFILDRHDSELDL

SEQ ID NO: 877624 - protein, 281 aa, Homo sapiens
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKVRNLF

SEQ ID NO: 877625 - protein, 72 aa, Homo sapiens
GKKTKKKKPTNHRRNHEHTIKYRPSPEIADWLPYSDHGVQATYHQVYAPSAITMPAPVMQPEPIKTVWSIHY

SEQ ID NO: 877626 - protein, 283 aa, Homo sapiens
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 877627 - protein, 295 aa, Homo sapiens
METESGPQTSNQMQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 877628 - protein, 90 aa, Homo sapiens
RGRFGGYAGLAGAAMLTLASPTAISHPAEEAGAAAETVFHKVHFSGYQVATYLKWCESYSFGTVVDFQIGKSKGPKRQLTGNDLILDGCC

SEQ ID NO: 877629 - protein, 134 aa, Homo sapiens
RGRFGGYAGLAGAAMLTLASPTAISHPAEEAGAAAETVFHKYSHEHSAEMNNQMTSCEIWRREGNGEHASAASVVSVGKHSDEVLSFPQKASQCPITSFTSVEGRAWASIVHQWRSIWHRTDPTIAVVTAVLAF

SEQ ID NO: 877630 - protein, 135 aa, Homo sapiens [sequence omitted]

SEQ ID NO: 877631 - protein, 30 aa, Homo sapiens
MRHALGEVEVPTVAQQSGGVLLLLQGQQQQ

SEQ ID NO: 877632 - protein, 109 aa, Homo sapiens
AALRAPEAAVAGGPPDFSSRPVLERLTGPRPAASLSLALRGLGDWAAGLRVRGGGRLRPGASWQREPRDGGPGRGGGAAAVSLGGEGAAGPARFPARKLREAWTSAHWR

SEQ ID NO: 877633 - protein, 109 aa, Homo sapiens; identical to SEQ ID NO: 877632

SEQ ID NO: 877634 - protein, 101 aa, Homo sapiens
AALRAPEAAVAGGPPDFSSRPVLERLTGPRPAASLSLALRGLGDWAAGLRVRGGGRLRPGASWQREPRDGGPGRGGGAAAVYSCRPGATARTTPPFSYPDS

SEQ ID NO: 877635 - protein, 109 aa, Homo sapiens; identical to SEQ ID NO: 877632

SEQ ID NO: 877636 - protein, 109 aa, Homo sapiens; identical to SEQ ID NO: 877632

SEQ ID NO: 877637 - protein, 53 aa, Homo sapiens
MAILARQGEHSTDCTYGRDCRAPCDRLMRQCKGDLIQPNLAKVCALLRGYCCL

SEQ ID NO: 877638 - protein, 109 aa, Homo sapiens; identical to SEQ ID NO: 877632

SEQ ID NO: 877639 - protein, 109 aa, Homo sapiens; identical to SEQ ID NO: 877632

SEQ ID NO: 877640 - protein, 109 aa, Homo sapiens; identical to SEQ ID NO: 877632

SEQ ID NO: 877641 - protein, 109 aa, Homo sapiens; identical to SEQ ID NO: 877632

SEQ ID NO: 877642 - protein, 96 aa, Homo sapiens
VSKDLSLSVRQVFAASEPTCPQGHSCISCPAVITGMGRLAWGQPLPLPGCCCVFLPARGHCQDHASLFISRFLSSAIVVFWWRKKNRVAVFELPGT

SEQ ID NO: 877643 - protein, 109 aa, Homo sapiens; identical to SEQ ID NO: 877632

SEQ ID NO: 877644 - protein, 204 aa, Homo sapiens
AVAGGPPDFSSRPVLERLTGPRPAASLSLALRGLGDWAAGLRVRGGGRLRPGASWQREPRDGGPGRGGGAAAVSLGGEGAAGPARFPARKLREAWGELSARIRILEKGTPFTHDPSAPAAASLSRSGCGKMFVGIFEKLISYAASGGFLVTVAAQREAVLAGGGLLGCLVGIPPRGPGPLIPAGDQQPAFRGHCVVTPTSPPAN

SEQ ID NO: 877645 - protein, 851 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 877646 - protein, 319 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQVLLLSTFYEEEQRLRKVK

SEQ ID NO: 877647 - protein, 156 aa, Homo sapiens
ELGDPGPDSFPPRSLFFSALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 877648 - protein, 77 aa, Homo sapiens
TLVGPRWLLCDFTVIKSIINCFIIPDLDSISPLILPSPSQKSHAVGPQEIRERATVLQTVFEDYVHSSERRVSWAKK

SEQ ID NO: 877649 - protein, 585 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCT

SEQ ID NO: 877650 - protein, 708 aa, Homo sapiens
MFSPKKHSVSTSDRNQEERQCIKTSSLFKNNPDIPELHRYVQGRMPFRKKKMCSAFSLLILALMPGFLFIICRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 877651 - protein, 333 aa, Homo sapiens
MGASQSTPPKTTPLGCLLRNRKALGLRSGIRSKRLIFYCNTAWPQYQLDNGSQWPENGTFDFNILRDLDNFCHRNEKWSEIPYIQAFFILRNHPSLCHSCSTFQILLTSSKPDSSPVTPPTDPADDSSSFDPVDFLPPRQHHDPPPEHHDPPPYVPAPALPLSPTLSNQPTSDSESSLPPPLTRSRAQCAQQPAPLLPLREVAGVEGIVHVHVPFSFYDLLQIEERLGSFSSDPDTYIKEFKYLTQSYELTWHDLYFILSSTLLPEEKERVWLAAQAYADDLHQQDPTKPVGAAAVPWEEPSWEYQPTEPGQVYCSHMITCLIAGLNKAAHRL

SEQ ID NO: 877652 - protein, 333 aa, Homo sapiens; identical to SEQ ID NO: 877651

SEQ ID NO: 877653 - protein, 110 aa, Homo sapiens [sequence omitted]

SEQ ID NO: 877654 - protein, 112 aa, Homo sapiens [sequence omitted]

SEQ ID NO: 877655 - protein, 333 aa, Homo sapiens; identical to SEQ ID NO: 877651

SEQ ID NO: 877656 - protein, 333 aa, Homo sapiens; identical to SEQ ID NO: 877651

SEQ ID NO: 877657 - protein, 333 aa, Homo sapiens; identical to SEQ ID NO: 877651

SEQ ID NO: 877658 - protein, 333 aa, Homo sapiens; identical to SEQ ID NO: 877651

SEQ ID NO: 877659 - protein, 333 aa, Homo sapiens; identical to SEQ ID NO: 877651

SEQ ID NO: 877660 - protein, 125 aa, Homo sapiens
MGASQSTPPKTTPLGCLLRNRKALGLRSGIRSKRLIFYCNTAWPQYQLDNGSQWPENGTFDFNILRDLDNFCHRNEKWSEIPYIQAFFILRNHPSLCHSCSTFQILLTSSKPDSSPVTPPTDPAA

SEQ ID NO: 877661 - protein, 333 aa, Homo sapiens; identical to SEQ ID NO: 877651

SEQ ID NO: 877662 - protein, 110 aa, Homo sapiens [sequence omitted]

SEQ ID NO: 877663 - protein, 333 aa, Homo sapiens; identical to SEQ ID NO: 877651

SEQ ID NO: 877664 - protein, 333 aa, Homo sapiens; identical to SEQ ID NO: 877651

SEQ ID NO: 877665 - protein, 333 aa, Homo sapiens; identical to SEQ ID NO: 877651

SEQ ID NO: 877666 - protein, 333 aa, Homo sapiens; identical to SEQ ID NO: 877651

SEQ ID NO: 877667 - protein, 333 aa, Homo sapiens; identical to SEQ ID NO: 877651

SEQ ID NO: 877668 - protein, 134 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877669 - protein, 134 aa, Homo sapiens; identical to SEQ ID NO: 877668

SEQ ID NO: 877670 - protein, 164 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESLAVASGSTFLVLRRPLLRLAPSPAELFVVGLSLSHLSGISRPRLLRF

SEQ ID NO: 877671 - protein, 75 aa, Homo sapiens
LGTQVPTCPRSSWVVWTREPSLWRYFAGNLASGGAAGATSLCFVYPLDFARTRLAADVGKAGAEREFRGLGDWPG

SEQ ID NO: 877672 - protein, 134 aa, Homo sapiens; identical to SEQ ID NO: 877668

SEQ ID NO: 877673 - protein, 134 aa, Homo sapiens; identical to SEQ ID NO: 877668

SEQ ID NO: 877674 - protein, 160 aa, Homo sapiens
DGRVGRPTRPGSRPSPVLQQSASSFNMTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877675 - protein, 134 aa, Homo sapiens; identical to SEQ ID NO: 877668

SEQ ID NO: 877676 - protein, 141 aa, Homo sapiens
STDAWVDPRVAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877677 - protein, 120 aa, Homo sapiens
MTDAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877678 - protein, 110 aa, Homo sapiens
SNGSRQSRSTLSMTGCPPIEGGASDVPDVPGQSEVGYSACGRPERSRFWRTGNVIRYFPTQALNFAFKDKYKQIFLGGVDKRTQFVALLCRESGIGWCRRGHIPVFCVPS

SEQ ID NO: 877679 - protein, 171 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQAGWGNPKEMEKKPPQRVFLGRLYFLGRGLASGGAAGATSLCFVYPLDFARTRLAADVGKAGAEREFRGLGDWPG

SEQ ID NO: 877680 - protein, 134 aa, Homo sapiens; identical to SEQ ID NO: 877668

SEQ ID NO: 877681 - protein, 76 aa, Homo sapiens
RLLEDPHRFAGAAAAMMMQSGRKGTDIMYTGTLDCWRKIARDEGGKAFFKGAWSNVLRGMGGAFVLVLYDEIKKYT

SEQ ID NO: 877682 - protein, 134 aa, Homo sapiens; identical to SEQ ID NO: 877668

SEQ ID NO: 877683 - protein, 134 aa, Homo sapiens; identical to SEQ ID NO: 877668

SEQ ID NO: 877684 - protein, 134 aa, Homo sapiens; identical to SEQ ID NO: 877668

SEQ ID NO: 877685 - protein, 134 aa, Homo sapiens; identical to SEQ ID NO: 877668

SEQ ID NO: 877686 - protein, 134 aa, Homo sapiens; identical to SEQ ID NO: 877668

SEQ ID NO: 877687 - protein, 160 aa, Homo sapiens
FGTRPVSRSSGSRPSPVLQQSASSFNMTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877688 - protein, 134 aa, Homo sapiens; identical to SEQ ID NO: 877668

SEQ ID NO: 877689 - protein, 133 aa, Homo sapiens
AERDGSSSGDLRRSCGPQGDRALCGTRPNASEPGFEVQHASKQITADKQYKGIIDCVVRIPKEQGVLSFWRGNLANVIRYFPTQALNFAFKDKYKQIFLGGVDKRTQFVALLCRESGIGWCRRGHIPVFCVPS

SEQ ID NO: 877690 - protein, 75 aa, Homo sapiens
RRTRGSTHASSSWVVWTREPSLWRYFAGNLASGGAAGATSLCFVYPLDFARTRLAADVGKAGAEREFRGLGDWPG

SEQ ID NO: 877691 - protein, 211 aa, Homo sapiens
MRLTLVLVLLQGFLSRHIVTSPFLPSPRPLSGSSVQVPGVLWTRPFLSPGQVPRASTGGAESSPGPPSTTPPPASWATQRLCRPARRGPDPAPAAASDACRSSSGSPYINRHLLRSARSAGVKAGSRPSPVLQQSASSFNMTDAAVSFAKDFLAGGVAAAISKTAVAPIERVKLLLQMWVKLELKGNSEASVTGLVKIYKSDGIKGPVPRL

SEQ ID NO: 877692 - protein, 700 aa, Homo sapiens
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 877693 - protein, 728 aa, Homo sapiens
PRRGSPGITEERVPGFESLLPSRPGPALTVHAGEGQRLRPQLLLHRDLQVKLDVVHAGDDFLHGGGGGPTGPAPPRSPAAFSPLPAAGPAAHTPPSLRLAAAAAAARGMPGAPGARAGPCACPGTANRDSAVPLVPASRQPNTGLARNLKPAACVGDADCACALGERGTRGRDWFAAGTGQGSPSECTAPDTSSPGGTGKPEMDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 877694 - protein, 700 aa, Homo sapiens; identical to SEQ ID NO: 877692

SEQ ID NO: 877695 - protein, 700 aa, Homo sapiens; identical to SEQ ID NO: 877692

SEQ ID NO: 877696 - protein, 87 aa, Homo sapiens
MKKRDLEPSDATYTALFNVCAESPWKDSALQSALKLRQQLQAKNFELNLKTYHALLKMAAKCADLRMCLDVFKVGLPLPSCSPSWGW

SEQ ID NO: 877697 - protein, 700 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877698 - protein, 769 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877699 - protein, 812 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877700 - protein, 509 aa, Homo sapiens
MPRKYVVWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877701 - protein, 649 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877702 - protein, 562 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877703 - protein, 282 aa, Homo sapiens [sequence omitted]

SEQ ID NO: 877704 - protein, 604 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877705 - protein, 361 aa, Homo sapiens
APFTGGAAAHVSTSGGYIFYTFSTVHPIPDEDSPWITDSTDRIPATTASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877706 - protein, 763 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSSGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877707 - protein, 498 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877708 - protein, 769 aa, Homo sapiens; identical to SEQ ID NO: 877698

SEQ ID NO: 877709 - protein, 769 aa, Homo sapiens; identical to SEQ ID NO: 877698

SEQ ID NO: 877710 - protein, 769 aa, Homo sapiens; identical to SEQ ID NO: 877698

SEQ ID NO: 877711 - protein, 769 aa, Homo sapiens; identical to SEQ ID NO: 877698

SEQ ID NO: 877712 - protein, 769 aa, Homo sapiens; identical to SEQ ID NO: 877698

SEQ ID NO: 877713 - protein, 769 aa, Homo sapiens; identical to SEQ ID NO: 877698

SEQ ID NO: 877714 - protein, 769 aa, Homo sapiens; identical to SEQ ID NO: 877698

SEQ ID NO: 877715 - protein, 762 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASRTHYWPLYLLYVFFLNFPIMQNSKKSQHIHT

SEQ ID NO: 877716 - protein, 702 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRS

SEQ ID NO: 877717 - protein, 702 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRR

SEQ ID NO: 877718 - protein, 472 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAGDCGSMAWVKKYFSFIFL

SEQ ID NO: 877719 - protein, 472 aa, Homo sapiens; identical to SEQ ID NO: 877718

SEQ ID NO: 877720 - protein, 145 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFL

SEQ ID NO: 877721 - protein, 341 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATIQATPSSTTEETATQKEQWFGNRWHEGYRQTPREDSHSTTGTAGNGWFNK

SEQ ID NO: 877722 - protein, 343 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATIQATPSSTTEETATQKEQWFGNRWHEGYRQTPSVSRFIYMHEYHVIICSRIE

SEQ ID NO: 877723 - protein, 274 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPTG

SEQ ID NO: 877724 - protein, 160 aa, Homo sapiens
APFTGGAAAHVSTSGGYIFYTFSTVHPIPDEDSPWITDSTDRIPATTASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSSKDYKT

SEQ ID NO: 877725 - protein, 192 aa, Homo sapiens
LWHTCPMMYPWIHLDRSYPMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRR

SEQ ID NO: 877726 - protein, 484 aa, Homo sapiens
MQVTTTGTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877727 - protein, 761 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877728 - protein, 472 aa, Homo sapiens; identical to SEQ ID NO: 877718

SEQ ID NO: 877729 - protein, 319 aa, Homo sapiens
MQVTTTGTSSNTISAGWEPNEENEDERDRHLSFSGSGIDDDEDFISSTNMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877730 - protein, 647 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTNMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877731 - protein, 430 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLCMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 877732 - protein, 472 aa, Homo sapiens; identical to SEQ ID NO: 877718

SEQ ID NO: 877733 - protein, 769 aa, Homo sapiens; identical to SEQ ID NO: 877698

SEQ ID NO: 877734 - protein, 769 aa, Homo sapiens; identical to SEQ ID NO: 877698

SEQ ID NO: 877735 - protein, 769 aa, Homo sapiens; identical to SEQ ID NO: 877698

SEQ ID NO: 877736 - protein, 769 aa, Homo sapiens; identical to SEQ ID NO: 877698

SEQ ID NO: 877737 - protein, 430 aa, Homo sapiens; identical to SEQ ID NO: 877731

SEQ ID NO: 877738 - protein, 430 aa, Homo sapiens; identical to SEQ ID NO: 877731

SEQ ID NO: 877739 - protein, 738 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRMLSPNTKGDGVQGGPLQKLQVREVLVRVGDNIRYRA

SEQ ID NO: 877740 - protein, 637 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGNLAFII

SEQ ID NO: 877741 - protein, 345 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSTTLQPTANPNTGLVEDLDRTGPLSMTTQQSNSQSFSTSERAAGTELD

SEQ ID NO: 877742 - protein, 395 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGGCTHEGDDTKSC

SEQ ID NO: 877743 - protein, 320 aa, Homo sapiens
VFCVLFVCRTDVQSSARRALLLSLFNILFCGFLALFARYAEEPGVGTANTETSEGFEILLFLSDDSSFLLLETFRTGMTGPVSWVASFSSSAELSPFLGAEGFLGKRMSLERYSFSRCTLACRDSVDLFRLLGSTEMPMVRATFLGMYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSKENKSLCFPIAIPWQNVSDLPEHCTLTC

SEQ ID NO: 877744 - protein, 59 aa, Homo sapiens
MQVTTTGTSSNTISAGWEPNEENEDERDRHLSFSGSGIDDDEDFISSTSKNNQLQYSHL

SEQ ID NO: 877745 - protein, 399 aa, Homo sapiens
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 877746 - protein, 136 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRVSYPAVGCP

SEQ ID NO: 877747 - protein, 257 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 877748 - protein, 275 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKVQTAEEDHPRGCPSHCSRLDGPDK

SEQ ID NO: 877749 - protein, 441 aa, Homo sapiens
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRYCPQSHLPSALPSPDSCPPHCPVYSTSLSSSKGLRAFLLSCRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 877750 - protein, 287 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERGVLPSPEVVLLALRAHLGGGSNTSLWLRISVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 877751 - protein, 257 aa, Homo sapiens; identical to SEQ ID NO: 877747

SEQ ID NO: 877752 - protein, 350 aa, Homo sapiens
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERGDTGMKTRLEDITTPRGCASFQESCQAQKLCSWPCVLMFGTIPGGGAFCQLDRGRAELSSPTAHQPGLGGALGLASSQQGRGPAGGRGSRRGKPSGASGLDRRDAGPCAAGNWEA

SEQ ID NO: 877753 - protein, 257 aa, Homo sapiens; identical to SEQ ID NO: 877747

SEQ ID NO: 877754 - protein, 35 aa, Homo sapiens
MPDHSKSAQKVLTITAIRVEKGVSAGYRNAGSRFD

SEQ ID NO: 877755 - protein, 257 aa, Homo sapiens; identical to SEQ ID NO: 877747

SEQ ID NO: 877756 - protein, 275 aa, Homo sapiens; identical to SEQ ID NO: 877748

SEQ ID NO: 877757 - protein, 257 aa, Homo sapiens; identical to SEQ ID NO: 877747

SEQ ID NO: 877758 - protein, 257 aa, Homo sapiens; identical to SEQ ID NO: 877747

SEQ ID NO: 877759 - protein, 211 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERGDTGMKTRLEDITTPRGCASFQESCQAQKLCSWPCVLMFGTIPGGGAFCQLDRGRAELSSPTAHQPGLGGALGLASSQQGRGPAGGRGSRRGKPSGASGLDRRDAGPCAAGNWEGTDC

SEQ ID NO: 877760 - protein, 452 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 877761 - protein, 386 aa, Homo sapiens
MEGGLAGERARESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 877762 - protein, 425 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISSFFGAASQYWTSPTGGIYPNPNVPRHPNTHVPSHLGSYY

SEQ ID NO: 877763 - protein, 419 aa, Homo sapiens
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 877764 - protein, 117 aa, Homo sapiens
TALPRLCRGSQIVEAYLCRALGHKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 877765 - protein, 179 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPAGNSRTRLPGRHSLPHSLGGQGASKPLSDTLFPVELQNGESCTPAGSGGSRL

SEQ ID NO: 877766 - protein, 231 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLWAINKTPNEQSSPIECQENPLLNQPERSWGIN

SEQ ID NO: 877767 - protein, 452 aa, Homo sapiens; identical to SEQ ID NO: 877760

SEQ ID NO: 877768 - protein, 220 aa, Homo sapiens
PTSYPPQTGSYSQAPSQYSQQSSSYGQQNPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 877769 - protein, 452 aa, Homo sapiens; identical to SEQ ID NO: 877760

SEQ ID NO: 877770 - protein, 200 aa, Homo sapiens
RKSTCSRRLPGVPGLPLACDPDGRQSAGGRGVPVSARGEDPGAGADGVPLRGVPAGARSRRLVLPTCAGVARAREDAEHGREKHGKEAEPGSQVLGGGGHAKDGIYDINREQDYVKNSEGILGENELRPPSQLHSLLEKIETGSLSEKIFETVSLSSDSLFQRAVSLLHTSYLDSSSEHGFQYSQVTLVKNDIFLNEVRC

SEQ ID NO: 877771 - protein, 142 aa, Homo sapiens
RKSTCSRRLPGVPGLPLACDPDGRQSAGGRGVPVSARGEEKHGKEAEPGSQVLGGGGHAKDGTKLFTNKKKQVVILRKNFKTLTGFFCLILSGRQNWYVSVDSVLAAVLLPLWVIQPKVYTFPNTPTVFIQDHGIMGNLVML

SEQ ID NO: 877772 - protein, 184 aa, Homo sapiens
RKSTCSRRLPGVPGLPLACDPDGRQSAGGRGVPVSARGEDPGAGADGVPLRGVPAGARSRRLVLPTCAGVARAREDAEHGREKHGKEAEPGSQVLGGGGHAKDGTKLFTNKKKQVVILRKNFKTLTGFFCLILSGRQNWYVSVDSVLAAVLLPLWVIQPKVYTFPNTPTVFIQDHGIMGNLVML

SEQ ID NO: 877773 - protein, 285 aa, Homo sapiens
RKSTCSRRLPGVPGLPLACDPDGRQSAGGRGVPVSARGEDPGAGADGVPLRGVPAGARSRRLVLPTCAGVARAREDAEHGREKHGKEAEPGSQVLGGGGHAKDGTKLFTNKKKQVVILRKNFKTLTGFFCLILSGRQNWYVSVDSVLAAVLLPLWVIQPKYYFYELSGNTVIERPRQICPYVIVAFRYRESKTMAPPAHKSILERSENVLMSPWKGKLIVQDRMLCDIALWSTYGAMIPTQLPQELDFKYVMKVSSLKKRLPEAAFRKQNYLEENLFSRFVLQFV

SEQ ID NO: 877774 - protein, 104 aa, Homo sapiens
RKSTCSRRLPGVPGLPLACDPDGRQSAGGRGVPVSARGEDPGAGADGVPLRGVPAGARSRRLVLPTCAGVARAREDAEHGREKHGKEAEPGSQVLGGGGHAKDG

SEQ ID NO: 877775 - protein, 159 aa, Homo sapiens
RKSTCSRRLPGVPGLPLACDPDGRQSAGGRGVPVSARGEDPGAGADGVPLRGVPAGARSRRLVLPTCAGVARAREDAEHGREKHGKEAEPGSQVLGGGGHAKDGIYDINREQDYVKNSEGILGENELRPPSQLHSLLEKIETGSLSEKIQNFLPTKKSK

SEQ ID NO: 877776 - protein, 243 aa, Homo sapiens
RKSTCSRRLPGVPGLPLACDPDGRQSAGGRGVPVSARGEEKHGKEAEPGSQVLGGGGHAKDGTKLFTNKKKQVVILRKNFKTLTGFFCLILSGRQNWYVSVDSVLAAVLLPLWVIQPKYYFYELSGNTVIERPRQICPYVIVAFRYRESKTMAPPAHKSILERSENVLMSPWKGKLIVQDRMLCDIALWSTYGAMIPTQLPQELDFKYVMKVSSLKKRLPEAAFRKQNYLEENLFSRFVLQFV

SEQ ID NO: 877777 - protein, 87 aa, Homo sapiens
RRHYQSTSLKDHVSEGWSTALDMLTRNRGSPVSPTVLDMWGQEGTHECVVMSQEHHGMTFRSGMTRSCLEDGLGLCTFIRQGPTQLD

SEQ ID NO: 877778 - protein, 920 aa, Homo sapiens
GRGAGAEPGPATASPAAGQRPPSPGPMPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDQRERRPRGASSAGEASEKEPLKLDPSRKAPPPGPSRPAVRLVDAVGDAKPQPVDSWV

SEQ ID NO: 877779 - protein, 1008 aa, Homo sapiens
MEVGIVLNATMSMTPSTSQGALTRVGITRGPWYPHPTELTLLCLQLAGALVMEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDQRERRPRGASSAGEASEKEPLKLDPSRKAPPPGPSRPAVRLVDAVGDAKPQPVDSWV

SEQ ID NO: 877780 - protein, 287 aa, Homo sapiens
LLTTLTPEAARALRTSVRHWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDQRERRPRGASSAGEASEKEPLKLDPSRKAPPPGPSRPAVRLVDAVGDAKPQPVDSWV

SEQ ID NO: 877781 - protein, 920 aa, Homo sapiens; identical to SEQ ID NO: 877778

SEQ ID NO: 877782 - protein, 920 aa, Homo sapiens; identical to SEQ ID NO: 877778

SEQ ID NO: 877783 - protein, 87 aa, Homo sapiens; identical to SEQ ID NO: 877777

SEQ ID NO: 877784 - protein, 56 aa, Homo sapiens
DSKPRDAEWTTVFKNTSGCLRCGPDLVLKPTCTPGPVLVVPDSVEDGGELRSARAL

SEQ ID NO: 877785 - protein, 1047 aa, Homo sapiens
GLGLRAGPGGRGRPPHRSELRPRGLRPAPRRTAPRPGNAAPRAPTDPGKPFWGPRPRCGAAHAALQEPEPAGWVSGHADLPSRQLAGALVMEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDQRERRPRGASSAGEASEKEPLKLDPSRKAPPPGPSRPAVRLVDAVGDAKPQPVDSWV

SEQ ID NO: 877786 - protein, 893 aa, Homo sapiens
GRGAGAEPGPATASPAAGQRPPSPGPMPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDQRERRPRGASSAGEASEKEPLKGPGPASCS

SEQ ID NO: 877787 - protein, 920 aa, Homo sapiens; identical to SEQ ID NO: 877778

SEQ ID NO: 877788 - protein, 920 aa, Homo sapiens; identical to SEQ ID NO: 877778

SEQ ID NO: 877789 - protein, 152 aa, Homo sapiens
MGHLWRLPGAHSFTKLVKRGKKAAPVLPVARHCKPPTSYSDHLENWLNMHQRLSRTENLMPWRSDSVRGAGDTMLRWFSSGPPSLDSPPFKSWSLTEVAGSQDRATALQPGQQSERLSRETTTKSWSLRPSTHLYSQHFGRLRQEDRLRPGV

SEQ ID NO: 877790 - protein, 94 aa, Homo sapiens
MAVALHLGFELLYQPEVVRLYLSLLTESRNFNTLEAAAGALQNLSAGNWMVRDQVGQGGQVLREGIPGTSLVQLLPRLAGKGGATPPPQDPRGV

SEQ ID NO: 877791 - protein, 105 aa, Homo sapiens
MAPPPLGPGQEGPCPCPHYRPGLRGWRNPSPLPRATGPWVPALPPRFGSSRGPHCGDKKGMEWGKRRSRRPSSFCCPGVGASPLWRAGGRRWKPQGLAFLKLVLF

SEQ ID NO: 877792 - protein, 105 aa, Homo sapiens; identical to SEQ ID NO: 877791

SEQ ID NO: 877793 - protein, 340 aa, Homo sapiens; identical to SEQ ID NO: 853209

SEQ ID NO: 877794 - protein, 340 aa, Homo sapiens; identical to SEQ ID NO: 853209

SEQ ID NO: 877795 - protein, 314 aa, Homo sapiens
LFFKTRQLSRSHLEIPRDPETRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877796 - protein, 279 aa, Homo sapiens
PTPFPTRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877797 - protein, 232 aa, Homo sapiens
MGSSSSGTATPPTSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877798 - protein, 340 aa, Homo sapiens; identical to SEQ ID NO: 853209

SEQ ID NO: 877799 - protein, 195 aa, Homo sapiens
LRILTDARNQLITYDSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877800 - protein, 132 aa, Homo sapiens
GSPSEMTVGCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877801 - protein, 301 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRALPMPTLQARAAGLAQSQPPSPGHGALGPCPPTQVWFLPGPPLWR

SEQ ID NO: 877802 - protein, 175 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCAGILKNAAA

SEQ ID NO: 877803 - protein, 119 aa, Homo sapiens
GAGCGVGQGHRALAGSDPGASPAPQVHAIPLRSSWVMTCAYAPSGNFVACGGLDNICSIYSLKTREGNVRVSRELPGHTGEGPGPVRALFGVGGCTALRVETWLTSSFPRVPVVLPLPG

SEQ ID NO: 877804 - protein, 103 aa, Homo sapiens
RPPTTTTARIQASNDVPAHAHTTGQGCGAGAIPAPFPGPRGLGSLPSHPGLVPPGAPTVEIRRGWNGGRGGAGGPHPSAALGLGPHPSGGPEAGGGNPRGWLF

SEQ ID NO: 877805 - protein, 97 aa, Homo sapiens
VTLEDYYCNSSRCRQTFIGHESDINAVAFFPNGYAFTTGSDDATCRLFDLRADQELLMYSHDNIICGITSVAFSRSGRLLLAGYDDCLDYKGGYPRS

SEQ ID NO: 877806 - protein, 397 aa, Homo sapiens
PSGPRCNPAFLPTSPAASGLTSALHPPGLGPAARSCLPQPPSRGPQPPPTLPHGPGAMSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877807 - protein, 319 aa, Homo sapiens
LQRIHGTHLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877808 - protein, 340 aa, Homo sapiens; identical to SEQ ID NO: 853209

SEQ ID NO: 877809 - protein, 370 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGEGPGPVRALFGVGGCTALRVETWLTSSFPRYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 877810 - protein, 340 aa, Homo sapiens; identical to SEQ ID NO: 853209

SEQ ID NO: 877811 - protein, 311 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVASPTMAWLWPRAPGTPSSRSGTNGPTPTGPRPGGALPMPTLQARAAGLAQSQPPSPGHGALGPCPPTQVWFLPGPPLWR

SEQ ID NO: 877812 - protein, 205 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVIQAPDTNVRPIGGPGTST

SEQ ID NO: 877813 - protein, 173 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCATQRAGT

SEQ ID NO: 877814 - protein, 73 aa, Homo sapiens
YLQLSLMNNSQLPVDHILAGSFETAMRLLHDQVGVIQFGPYKQLFLQTYARGRTTYQALPCLPSMYGYPNRNW

SEQ ID NO: 877815 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877816 - protein, 1224 aa, Homo sapiens; identical to SEQ ID NO: 877815

SEQ ID NO: 877817 - protein, 1224 aa, Homo sapiens; identical to SEQ ID NO: 877815

SEQ ID NO: 877818 - protein, 1224 aa, Homo sapiens; identical to SEQ ID NO: 877815

SEQ ID NO: 877819 - protein, 1132 aa, Homo sapiens
MFKAFVWNIFQEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877820 - protein, 1042 aa, Homo sapiens
RIRDTSDLLTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877821 - protein, 1233 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHEHSCPLPLTAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877822 - protein, 912 aa, Homo sapiens
EDSCDDSVDGNGSYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877823 - protein, 1175 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877824 - protein, 852 aa, Homo sapiens
MTSEDESGTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877825 - protein, 633 aa, Homo sapiens
YNKKKPMLIRDEDHTKYYEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877826 - protein, 533 aa, Homo sapiens [sequence omitted]

SEQ ID NO: 877827 - protein, 503 aa, Homo sapiens
MIRSDWTRGRVQQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877828 - protein, 285 aa, Homo sapiens [sequence omitted]

SEQ ID NO: 877829 - protein, 1172 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQVDGTPSVTIGKPDQLLHGGSRPRSLPLKQSNK

SEQ ID NO: 877830 - protein, 987 aa, Homo sapiens [sequence omitted]

SEQ ID NO: 877831 - protein, 733 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEVRGIWSSAPYCLRGERVRVPLGGHYSGLASLARIMKFGIFFSCYIEPSSCCYLPISTFTCLCFCHRISIFVNLN

SEQ ID NO: 877832 - protein, 527 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALKITWLK

SEQ ID NO: 877833 - protein, 359 aa, Homo sapiens [sequence omitted]

SEQ ID NO: 877834 - protein, 214 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHEQWSEILLES

SEQ ID NO: 877835 - protein, 194 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGHIT

SEQ ID NO: 877836 - protein, 113 aa, Homo sapiens
MLTKFETKSARVKGLSFHPKRPWILTSLHNGVIQLWDYRMCTLIDKFDEHDGPVRGIDFHKQQPLFVSGGDDYKIKVQRAVITENKGQRMWEGLGIMKGTERQEISFIQSSGL

SEQ ID NO: 877837 - protein, 1224 aa, Homo sapiens; identical to SEQ ID NO: 877815

SEQ ID NO: 877838 - protein, 1224 aa, Homo sapiens; identical to SEQ ID NO: 877815

SEQ ID NO: 877839 - protein, 1224 aa, Homo sapiens; identical to SEQ ID NO: 877815

SEQ ID NO: 877840 - protein, 1224 aa, Homo sapiens; identical to SEQ ID NO: 877815

SEQ ID NO: 877841 - protein, 1086 aa, Homo sapiens [sequence omitted]

SEQ ID NO: 877842 - protein, 1041 aa, Homo sapiens
TDVRGYGKTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877843 - protein, 893 aa, Homo sapiens
MLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877844 - protein, 933 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLVGLKMVSLCPQPREQVQLRSGVITLSFQLITSWQALSKQPCGSFMTK

SEQ ID NO: 877845 - protein, 827 aa, Homo sapiens
SDQFRATRDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877846 - protein, 633 aa, Homo sapiens
QYPRVLRSRGWVARKYDWRVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877847 - protein, 528 aa, Homo sapiens
CQLRLVLEKGSCSVALARMLGLSVGTSVPGPHLSYLEIVSNKRVQRANFTSRGCTCLCKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 877848 - protein, 1150 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQNPLNPLVNKK

SEQ ID NO: 877849 - protein, 246 aa, Homo sapiens [sequence omitted]

SEQ ID NO: 877850 - protein, 556 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTG

SEQ ID NO: 877851 - protein, 463 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDGKCSFCLPHSASSSPHPHHNSSSSFSHSIPKPWPHHSCLLAGAADNCIRGDHGVKYS

SEQ ID NO: 877852 - protein, 210 aa, Homo sapiens [sequence omitted]

SEQ ID NO: 877853 - protein, 129 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVW

SEQ ID NO: 877854 - protein, 73 aa, Homo sapiens
GTGEGAPQTRTTLGVAENRESWLRQLDKHSQATAQQLVQLLSKQNQLLLERQSLSEEVDRLRTQLPSMPQSDC

SEQ ID NO: 877855 - protein, 231 aa, Homo sapiens
SSVRDSRLPCDSRGRKQAGAPRPQACCSRKGESRTFPHVTPSSGPRVRAWRSPRRTLPWRRFWGSINGVSGEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRERDDLMSALVSVRSSLADTQQREASAYEQVKQVLQISEEANFEKTKASLIRCK

SEQ ID NO: 877856 - protein, 713 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877857 - protein, 666 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELNFLIISNKKSGRIKQYLHSPPCQPLMTSLQLSEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877858 - protein, 677 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQSYPACHNLIADLDGTE

SEQ ID NO: 877859 - protein, 431 aa, Homo sapiens
LPSVWASLRRREMVRSGARPGQEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877860 - protein, 398 aa, Homo sapiens
MSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877861 - protein, 237 aa, Homo sapiens
PPPLSLLSGSGFTDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877862 - protein, 360 aa, Homo sapiens
IRNESQEMQKGTDTSQQRKLKGFGYKWRGSQHISGRKKVDEDMIMKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877863 - protein, 246 aa, Homo sapiens
PRPQPTNQNLEIKKKFRGNKNRDFEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877864 - protein, 363 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKASLIRCK

SEQ ID NO: 877865 - protein, 221 aa, Homo sapiens
SSVRDSRLPCDSRGRKQAGAPRPQACCSRKGESRTFPHVTPSSGPRVRAWRSPRRTLPWRRFWGSINGVSGEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNKNHGRARWLTPVIPALWEAEAGESRGQEIETILANMVKPRFY

SEQ ID NO: 877866 - protein, 634 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877867 - protein, 641 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRNSVSSMGEYMRR

SEQ ID NO: 877868 - protein, 591 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877869 - protein, 412 aa, Homo sapiens
MQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877870 - protein, 322 aa, Homo sapiens [sequence omitted]

SEQ ID NO: 877871 - protein, 225 aa, Homo sapiens
MNHEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 877872 - protein, 360 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKHPSQ

SEQ ID NO: 877873 - protein, 290 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNKNHGRARWLTPVIPALWEAEAGESRGQEIETILANMVKPRFY

SEQ ID NO: 877874 - protein, 110 aa, Homo sapiens
GSAGLGVLGRDGERGGWAGARGAVSFPHAAPRARASTSSLTERCGAGDPWRARGGTVARPAWAQRVASAVSGCAGWKIRLPGHAVPAERPQLRGSALVLPARSRVAARAR

SEQ ID NO: 877875 - protein, 1980 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877876 - protein, 721 aa, Homo sapiens
MRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877877 - protein, 2252 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGYRAENGTVGPLSPFFLLILMKGCEGLAACLTGRRCIPSAMQVNTRDSEWLGVFPRSHPGCQHIEGSDQVLCDSKISPFHDLLTNLKIKVRAFFILSLDCLCQPMTDNLLTAGMEAPAGQPESSPVLTSQSGETHRRSLRNWQLTLNTRCLVPHPVSSNSSPASCLSPLPVLSPSSSVSSFQFCPQKIRRFWVSQQGGRSESACVCYTLGLVVLGTYRGSRVGGSGTWRLCFLSFTHGCGDTQGACSTRQGTEGEAVFSPGDTPRGSFVVLGSCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877878 - protein, 1074 aa, Homo sapiens [sequence omitted]

SEQ ID NO: 877879 - protein, 1058 aa, Homo sapiens
MIGPVPGLISYGAGLGIQIGVTPKDSQKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877880 - protein, 1028 aa, Homo sapiens
MYTRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877881 - protein, 1555 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVRFHHF

SEQ ID NO: 877882 - protein, 721 aa, Homo sapiens; identical to SEQ ID NO: 877876

SEQ ID NO: 877883 - protein, 504 aa, Homo sapiens
RTDNGTTWQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877884 - protein, 1810 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRR

SEQ ID NO: 877885 - protein, 244 aa, Homo sapiens [sequence omitted]

SEQ ID NO: 877886 - protein, 1650 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSCAVSLSLYQPLLPSSVPL

SEQ ID NO: 877887 - protein, 1465 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVNYNYFVFTSVFSLLSLTPRYHWNHANTAYSLMWF

SEQ ID NO: 877888 - protein, 1518 aa, Homo sapiens [sequence omitted]

SEQ ID NO: 877889 - protein, 1350 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRSASAVACLVRAPLPPLGFTRSGINVCVWRVKIGEAWRRR

SEQ ID NO: 877890 - protein, 1194 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELK

SEQ ID NO: 877891 - protein, 515 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHVSTPILPFVTLDLNLVTLKPVFFFWSLSCLLTII

SEQ ID NO: 877892 - protein, 87 aa, Homo sapiens
STITTNFAGGVDQTLVSLSHTIEPVMKTSVTTSPQSDMMREQLQLSEATGTCLGERLKHLERLIRSSREEEVASELHLSALLDMVDI

SEQ ID NO: 877893 - protein, 1980 aa, Homo sapiens; identical to SEQ ID NO: 877875

SEQ ID NO: 877894 - protein, 2165 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKVLAASNWMLKNPRKFQSQTDIFITLLYILSVTKMYFVGQVQWLRPVIPALWEAEVGGSPEVRSLRPAWPTWLNPISTENTKISLAWWHTPVVPATRAAEAELLEPEEAEVVVSQDDTTALQPGFCLKKKNKPQDFYLSHYKVLLKCAHGLCFKLKSEKLRSYMILLTVASLHGNVCVILPLACGQDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877895 - protein, 1263 aa, Homo sapiens
MNLTAHFTSKTLLLSMVEIQYHYYLRQGLALSPRLEYSDAITAHCSLNLLGSNDPPTLASPRFGITGVSHCIWPVKSIIYQIYLHENFVLFKITFQPLFSPLINREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877896 - protein, 907 aa, Homo sapiens [sequence omitted]

SEQ ID NO: 877897 - protein, 1810 aa, Homo sapiens; identical to SEQ ID NO: 877884

SEQ ID NO: 877898 - protein, 551 aa, Homo sapiens
MVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877899 - protein, 721 aa, Homo sapiens; identical to SEQ ID NO: 877876

SEQ ID NO: 877900 - protein, 1810 aa, Homo sapiens; identical to SEQ ID NO: 877884

SEQ ID NO: 877901 - protein, 273 aa, Homo sapiens
MGRESCSSSYSRFCVSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 877902 - protein, 1598 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRAWRHH

SEQ ID NO: 877903 - protein, 1426 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMIFWQ

SEQ ID NO: 877904 - protein, 1245 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQR

SEQ ID NO: 877905 - protein, 879 aa, Homo sapiens [sequence omitted]

SEQ ID NO: 877906 - protein, 420 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDLRNASGLTAADIAQTQGFQECAQFLLNLQNCHLNHFYNNGILNGGHQNVFPNHISVGTNRKRCLEDSEDFGVKKARTEAQSLDSAVPLTNGDTEDDADKMHVDREFAVVTDMKNSSSVSNTLTNGCVINGHLDFPSTTPLSGMESRNGQCLTGTNGISSGLAPGQPFPSSQGSLCISGTEEPEKTLRANPELCGSLHLNGSPSSCIASRPSWVEDIGDNLYYGHYHGFGDTAESIPELNSVVEHSKSVKVQERYDSAVLGTMHLHHGS

SEQ ID NO: 877907 - protein, 220 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVEFISQSSVHSCLPGELQHGVTFDPSVLIQCLKPEKCQWPDSSRHCTNPGFPRVCPVSLEPPELSSEPFL

SEQ ID NO: 877908 - protein, 220 aa, Homo sapiens; identical to SEQ ID NO: 877907

SEQ ID NO: 877909 - protein, 172 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDYVIRIDLIFSSNPRKGEHSI

SEQ ID NO: 877910 - protein, 157 aa, Homo sapiens
MKNSSSVSNTLTNGCVINGHLDFPSTTPLSGMESRNGQCLTGTNGISSGLAPGQPFPSSQGSLCISGTEEPEKTLRANPELCGSLHLNGSPSSCIASRPSWVEDIGDNLYYGHYHGFGDTAESIPELNSVVEHSKSVKVQERYDSAVLGTMHLHHGS

SEQ ID NO: 877911 - protein, 169 aa, Homo sapiens
MHVDREFAVVTDMKNSSSVSNTLTNGCVINGHLDFPSTTPLSGMESRNGQCLTGTNGISSGLAPGQPFPSSQGSLCISGTEEPEKTLRANPELCGSLHLNGSPSSCIASRPSWVEDIGDNLYYGHYHGFGDTAESIPELNSVVEHSKSVKVQERYDSAVLGTMHLHHGS

SEQ ID NO: 877912 - protein, 169 aa, Homo sapiens; identical to SEQ ID NO: 877911

SEQ ID NO: 877913 - protein, 163 aa, Homo sapiens [sequence omitted]

SEQ ID NO: 877914 - protein, 155 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVELHL

SEQ ID NO: 877915 - protein, 155 aa, Homo sapiens [sequence omitted]

SEQ ID NO: 877916 - protein, 155 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVENSY

SEQ ID NO: 877917 - protein, 169 aa, Homo sapiens; identical to SEQ ID NO: 877911

SEQ ID NO: 877918 - protein, 220 aa, Homo sapiens; identical to SEQ ID NO: 877907

SEQ ID NO: 877919 - protein, 152 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVE

SEQ ID NO: 877920 - protein, 263 aa, Homo sapiens
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877921 - protein, 274 aa, Homo sapiens
MGHEQNQGAALLQMLPLLWLLPHSWAVPEGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877922 - protein, 268 aa, Homo sapiens
MRARTGVYRCQLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877923 - protein, 245 aa, Homo sapiens
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877924 - protein, 224 aa, Homo sapiens [sequence omitted]

SEQ ID NO: 877925 - protein, 140 aa, Homo sapiens
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTREERGVQRGYQEVQLGGQAREDPTVAQG

SEQ ID NO: 877926 - protein, 212 aa, Homo sapiens [sequence omitted]

SEQ ID NO: 877927 - protein, 295 aa, Homo sapiens
MGHEQNQGAALLQMLPLLWLLPHSWAVPEEQSMITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877928 - protein, 230 aa, Homo sapiens
CSTCPVPVMYRSMTKRRETRIDGHSINDTCNEYNVHYGGGGGLHSAIRPSIHSWNRLCNGGEYALWWRGEHSCPLTNTTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 877929 - protein, 251 aa, Homo sapiens [sequence omitted]

SEQ ID NO: 877930 - protein, 660 aa, Homo sapiens
PGPVLVQSIKKIKSTKALCGLDGLSTSQVQLSQSHSIHLPAMKNYLFSRNCQVKYSHIKPPFDVPGVPPESSHQTTSSPSAPGNAPSLAYGATQTVLSAFPCNAEAHLPSLGKQRPDVRPQRVKRQQLKPSESSPNRNNHRCQLRARGKRRCAPADCRFPGREPGSRWSVPVRNHGENPALLREKGSRFPRASYRHGAKTARVADQSNRQADQWAARVREDPDGGAGWREGGSFKASLTWLWPLGEMKLHCEVEVISRHLPALGLRNRGKGVRAVLSLCQQTSRSQPPVRAFLLISTLKDKRGTRYELRENIEQFFTKFVDEGKATVRLKEPPVDICLSKAISSSLKGFLSAMRLAHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNRIPYGSHIIPFHLCQDLDTAKICVCGRFCLNSFIQGTTTMNLHSVAHTVVLVDNLGGTEAPIISYFCSLGCYVNSSDMLK

SEQ ID NO: 877931 - protein, 392 aa, Homo sapiens
PGPVLVQSIKKIKSTKALCGLDGLSTSQVQLSQSHSIHLPAMKNYLFSRNCQVKYSHIKPPFDVPGVPPESSHQTTSSPSAPGNAPSLAYGATQTVLSAFPCNAEAHLPSLGKQRPDVRPQRVKRQQLKPSESSPNRNNHRCQLRARGKRRCAPADCRFPGREPGSRWSVPVRNHGENPALLREKGSRFPRASYRHGAKTARVADQSNRQADQWAARVREDPDGGAGWREGGSFKASLTWLWPLGEMKLHCEVEVISRHLPALGLRNRGKGVRAVLSLCQQTSRSQPPVRAFLLISTLKDKRGTRYELRENIEQFFTKFVDEGKATVRLKEPPVDICLSKDSIWLSYHSIPSLPRFGYRKNLCLWKILSELFHSRNYYHESAFCCPHCGLSR

SEQ ID NO: 877932 - protein, 379 aa, Homo sapiens
PGPVLVQSIKKIKSTKALCGLDGLSTSQVQLSQSHSIHLPAMKNYLFSRNCQVKYSHIKPPFDVPGVPPESSHQTTSSPSAPGNAPSLAYGATQTVLSAFPCNAEAHLPSLGKQRPDVRPQRVKRQQLKPSESSPNRNNHRCQLRARGKRRCAPADCRFPGREPGSRWSVPVRNHGENPALLREKGSRFPRASYRHGAKTARVADQSNRQADQWAARVREDPDGGAGWREGGSFKASLTWLWPLGEMKLHCEVEVISRHLPALGLRNRGKGVRAVLSLCQQTSRSQPPVRAFLLISTLKDKRGTRYELRENIEQFFTKFVDEGKATVRLKEPPVDICLSKMESHSVSQVGVQWEELGSLQPTGHFQQFKRFPFSYETGS

SEQ ID NO: 877933 - protein, 308 aa, Homo sapiens [sequence omitted]

SEQ ID NO: 877934 - protein, 392 aa, Homo sapiens; identical to SEQ ID NO: 877931

SEQ ID NO: 877935 - protein, 374 aa, Homo sapiens
PGPVLVQSIKKIKSTKALCGLDGLSTSQVQLSQSHSIHLPAMKNYLFSRNCQVKYSHIKPPFDVPGVPPESSHQTTSSPSAPGNAPSLAYGATQTVLSAFPCNAEAHLPSLGKQRPDVRPQRVKRQQLKPSESSPNRNNHRCQLRARGKRRCAPADCRFPGREPGSRWSVPVRNHGENPALLREKGSRFPRASYRHGAKTARVADQSNRQADQWAARVREDPDGGAGWREGGSFKASLTWLWPLGEMKLHCEVEVISRHLPALGLRNRGKGVRAVLSLCQQTSRSQPPVRAFLLISTLKDKRGTRYEVREVGRPCQSRVLLGSRDAGHPRSSCSRLLPRRKPALGVPELPALRPTISPTPGSCASSYGPERRKL

SEQ ID NO: 877936 - protein, 581 aa, Homo sapiens
PGPVLVQSIKKIKSTKALCGLDGLSTSQVQLSQSHSIHLPAMKNYLFSRNCQVKYSHIKPPFDVPGVPPESSHQTTSSPSAPGNAPSLAYGATQTVLSAFPCNAEAHLPSLGKQRPDVRPQRVKRQQLKPSESSPNRNNHRCQLRARGKRRCAPADCRFPGREPGSRWSVPVRNHGENPALLREKGSRFPRASYRHGAKTARVADQSNRQADQWAARVREDPDGGAGWREGGSFKASLTWLWPLGEMKLHCEVEVISRHLPALGLRNRGKGVRAVLSLCQQTSRSQPPVRAFLLISTLKDKRGTRYELRENIEQFFTKFVDEGKATVRLKEPPVDICLSKAISSSLKGFLSAMRLAHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNR

SEQ ID NO: 877937 - protein, 147 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 877938 - protein, 149 aa, Homo sapiens
MLSNRKCLSKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 877939 - protein, 147 aa, Homo sapiens; identical to SEQ ID NO: 877937

SEQ ID NO: 877940 - protein, 147 aa, Homo sapiens; identical to SEQ ID NO: 877937

SEQ ID NO: 877941 - protein, 147 aa, Homo sapiens; identical to SEQ ID NO: 877937

SEQ ID NO: 877942 - protein, 147 aa, Homo sapiens; identical to SEQ ID NO: 877937

SEQ ID NO: 877943 - protein, 147 aa, Homo sapiens; identical to SEQ ID NO: 877937

SEQ ID NO: 877944 - protein, 147 aa, Homo sapiens; identical to SEQ ID NO: 877937

SEQ ID NO: 877945 - protein, 147 aa, Homo sapiens; identical to SEQ ID NO: 877937

SEQ ID NO: 877946 - protein, 147 aa, Homo sapiens; identical to SEQ ID NO: 877937

SEQ ID NO: 877947 - protein, 147 aa, Homo sapiens; identical to SEQ ID NO: 877937

SEQ ID NO: 877948 - protein, 147 aa, Homo sapiens; identical to SEQ ID NO: 877937

SEQ ID NO: 877949 - protein, 147 aa, Homo sapiens; identical to SEQ ID NO: 877937

SEQ ID NO: 877950 - protein, 110 aa, Homo sapiens
MGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 877951 - protein, 110 aa, Homo sapiens; identical to SEQ ID NO: 877950

SEQ ID NO: 877952 - protein, 147 aa, Homo sapiens; identical to SEQ ID NO: 877937

SEQ ID NO: 877953 - protein, 147 aa, Homo sapiens; identical to SEQ ID NO: 877937

SEQ ID NO: 877954 - protein, 125 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPVMLP

SEQ ID NO: 877955 - protein, 147 aa, Homo sapiens; identical to SEQ ID NO: 877937

SEQ ID NO: 877956 - protein, 147 aa, Homo sapiens; identical to SEQ ID NO: 877937

SEQ ID NO: 877957 - protein, 148 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRLAREWTEKYAML

SEQ ID NO: 877958 - protein, 136 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSKGRRCTIPKSLSLGHGIDPTKGPYGERPVLHSRDSPEFRWPSVGT

SEQ ID NO: 877959 - protein, 123 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPGS

SEQ ID NO: 877960 - protein, 110 aa, Homo sapiens; identical to SEQ ID NO: 877950

SEQ ID NO: 877961 - protein, 147 aa, Homo sapiens; identical to SEQ ID NO: 877937

SEQ ID NO: 877962 - protein, 147 aa, Homo sapiens; identical to SEQ ID NO: 877937

SEQ ID NO: 877963 - protein, 147 aa, Homo sapiens; identical to SEQ ID NO: 877937

SEQ ID NO: 877964 - protein, 147 aa, Homo sapiens; identical to SEQ ID NO: 877937

SEQ ID NO: 877965 - protein, 147 aa, Homo sapiens; identical to SEQ ID NO: 877937

SEQ ID NO: 877966 - protein, 147 aa, Homo sapiens; identical to SEQ ID NO: 877937

SEQ ID NO: 877967 - protein, 147 aa, Homo sapiens; identical to SEQ ID NO: 877937

SEQ ID NO: 877968 - protein, 147 aa, Homo sapiens; identical to SEQ ID NO: 877937

SEQ ID NO: 877969 - protein, 110 aa, Homo sapiens; identical to SEQ ID NO: 877950

SEQ ID NO: 877970 - protein, 138 aa, Homo sapiens
ISSPGERDSSTMFVQVIGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 877971 - protein, 107 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKGDCTDL

SEQ ID NO: 877972 - protein, 147 aa, Homo sapiens; identical to SEQ ID NO: 877937

SEQ ID NO: 877973 - protein, 147 aa, Homo sapiens; identical to SEQ ID NO: 877937

SEQ ID NO: 877974 - protein, 156 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDNDHPTLPGMGPEYACYCPCSPAYR

SEQ ID NO: 877975 - protein, 130 aa, Homo sapiens
ASLVSGLPCLSALACLSALPCLSALPCLSALPCLWLYVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 877976 - protein, 130 aa, Homo sapiens; identical to SEQ ID NO: 877975

SEQ ID NO: 877977 - protein, 80 aa, Homo sapiens
TGMCTANSTHLPKRASHQGEQSRLKTPQLQKTNVVSCNRLIYIYATQKRNSTGNDLPKKVFKASVTSGNFRVFILPVSSH

SEQ ID NO: 877978 - protein, 104 aa, Homo sapiens
MGPCRDVFTVFVCVSVCLSVCLCLSLSGCIYCVGVCVCVCVCCVYVFVSLPGCVHRMHVYVFETHTPRDTPPLTLTSWTPGFVVVEQPPRLSVRLLGVCCLCGP

SEQ ID NO: 877979 - protein, 130 aa, Homo sapiens; identical to SEQ ID NO: 877975

SEQ ID NO: 877980 - protein, 115 aa, Homo sapiens
GQEVELWVSIKRGAAIGSPLVPSVYHSTEKSCLVCFGMCPSIYKKMKSVLLIGTRMLLWLSHISQGPRPEAVLPRAPSPSAAHPWLVFRKPGKRKPLGQMQKQKREGKPASGSPC

SEQ ID NO: 877981 - protein, 945 aa, Homo sapiens
ASTRPSQGETTLPAGGARRAQSPPGRWRLHGTAWSGAAPGQQSIPWPSLLVPAPYHRDAAWNSLLAIVDAPGRRVARGVAGLPQAVTEHPLVPGSPLRYSLVGWLSGGPDSPRSEVCSVFHSMTHRRFKVTSTVAAASLLPLQDGRRSCCANLPGCPLPGHGRGVSWQFLVLPGGLRVPPFCGRLQHIHPESLGVNTAAGDDHRLPSVQPWGCVLISAPPASCPAVQRLPMARGPAPAAPARPAQDRGGPCHSEDPPGGAEAPRVPGGPRVQLCGRPDPAGTGVSGPKTSLKACRGPEGHPRGARLGRGPYRSCTKLPTSWLGASQSLISLSVKRGIHSACLGDAEGWLSPDHRGIHSGAQGWAGSVGWGTDPRSSHEPCPTPLQGDDPEGLFAEANAVACTLDMVMAGTETTSATLQWAALLMGRHPDVQGRVQEELDRVLGPGRTPRLEDQQALPYTSAVLHEVQRFITLLPPGLPLTHAQDLTPAMSPAGPRPRPPTAVDPDAEPTLLREPQATVVFTTHVPTLGRYAFLLQLYTGGEAAWELKLPPPAVWAALQGARTQLRDVRAKKDQLEAHIQAAQAMLAMDTDETSKKIAHAKAVAAEAQDTATRVQSQLQAAAVCVGERLARTELFLLFAGLLQRYRLLPPPGVSPASLDATPARAFTMRPRAQALCAVLRPWSSPSPQVLLTTPLPALGPPTLSPPTPQLGLLWEGPEDSHPHPHPHRVSNCFRLHPGLPLPDPVGPPPLLMLSAAQSLPAPRSASRAPPTLPPLKLHSHPPSSPQGPPAPTAGAAGRQRVAASSQRQAQVGVLSVRALHPPGPGTPADPTPFPLLEHFLQLCLEAVGLQCQTLSQATGAMRMTGAGRQGPHSPSETGTGARGFLGAGEGTSAPEDKQHCSGKNGNTDPVRWFMPVIPALWEAEAGGSQGQEIETVLANMVKPCLY

SEQ ID NO: 877982 - protein, 500 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVTNTKISWV

SEQ ID NO: 877983 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 877984 - protein, 3695 aa, Homo sapiens; identical to SEQ ID NO: 877983

SEQ ID NO: 877985 - protein, 3526 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVGESPRGRWTSGRVVVELMDRAPQVKVPMKFNGRSGVQLRTPRDLADLAAYTALKFYLQGPEPEPGQGTEDRFVMYMGSRQVPGWLGGCGPSSGSVWKGAVPGPWSPVPIPTVCLSLPQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPTSQELHCLMWAWNWRCGPWQSPD

SEQ ID NO: 877986 - protein, 3828 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRREYPSPWAPSGRELVPEPKVDGSTRKQGQENVLEPGRAALLPHLRAWAQDFSLRAMQKVSGTSRWSTVSDDDVDSEQLPPCQELSKAQHPGQGSLFLSPPPPSHCHIPYGLHSGPLRGAGLGRGVSKPCTRPTACDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 877987 - protein, 3646 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAAWAPCWRLQLVPQPLCTSGACLSPWPCSPGPPPTAAA

SEQ ID NO: 877988 - protein, 3654 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPGCPAA

SEQ ID NO: 877989 - protein, 3444 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKSRRWRRTLCTAGRLGRR

SEQ ID NO: 877990 - protein, 3329 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGWAQHEAGLMDLREALNRAVDATREAQELNRLPSRLGHSQPRPLVRPLQLPHTAPCARLIGVYLDSKLYG

SEQ ID NO: 877991 - protein, 3226 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQHQHEFP

SEQ ID NO: 877992 - protein, 2053 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRREYPSPWAPSGRELVPEPKVDGSTRKQGQENVLEPGRAALLPHLRAWAQDFSLRAMQKVSGTSRWSTVSDDDVDSEQLPPCQELSKAQHPGQGSLFLSPPPPSHCHIPYGLHSGPLRGAGLGRGVSKPCTRPTACDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQVRLGQHQTARRLTCAHPSLQHPPCVPFLAASTSCHPTHLSSCPCFSQAAGQLMGLPVPCCLSACPSSACLPLIRLPL

SEQ ID NO: 877993 - protein, 370 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGSTALPTTLSTRPTSAAAATASPTSRMAPART

SEQ ID NO: 877994 - protein, 84 aa, Homo sapiens
VRWEKNRILLVTDGARAWSQEGPHRQHQGAEHPQPHTLFVGGLPASSHSSKLPVRTILPQPPLPTHCSLSAALGPDPCPVCSYR

SEQ ID NO: 877995 - protein, 34 aa, Homo sapiens
MVLASLEQLQIRALFSQISSAVSLRRVALEVASP

SEQ ID NO: 877996 - protein, 256 aa, Homo sapiens
RVRPGRDAPGPTPLVVNRRVPRLFIVENPPTPARVSLGPRLPGYLPSGPARPHGLALRTLLSGRRARPTNFFLFCDCFFFFETQFCSCCPGWSAMARSRLTITSASRVQAILLPQPPESWDYRHTPPRPANFVFLVQMGFLHVGQAGLELLTSGDLPISASQMLARVQEQLSSLWEENQALATQTRDRLAQHEAGLMDLREALNRAVDATREAQELNSRNQERLEEALVRTPDLFFLLLLFPPPPCNPSPLRLLPS

SEQ ID NO: 877997 - protein, 3695 aa, Homo sapiens; identical to SEQ ID NO: 877983

SEQ ID NO: 877998 - protein, 3719 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVGESPRGRWTSGRVVVELMDRAPQVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 877999 - protein, 3448 aa, Homo sapiens
MGLIPPPVYPKAAVHLPAQHLRGHLRPLLPRFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRREYPSPWAPSGRELVPEPKVDGSTRKQGQENVLEPGRAALLPHLRAWAQDFSLRAMQKVSGTSRWSTVSDDDVDSEQLPPCQELSKAQHPGQGSLFLSPPPPSHCHIPYGLHSGPLRGAGLGRGVSKPCTRPTACDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 878000 - protein, 1893 aa, Homo sapiens
MLHGFPVPRACRIPEGLTCELAGWGPSSSQSLMPPAPVHPQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 878001 - protein, 3579 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLEPMAVQPWPPAYCGCMRRLAVNRSPVAMTRSVEVHGAVGASGCPAA

SEQ ID NO: 878002 - protein, 794 aa, Homo sapiens
MDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 878003 - protein, 2871 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFMSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRWEAQERGRMPPTAGPLPVRHLSPLRVHPPPFTSPCP

SEQ ID NO: 878004 - protein, 1316 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLVRTPQVPTPRGQLLSEDLNMHERGEDSWGPRSPRRPHSLMPSPACFFWNPSCKRFVDSVPFDVPPSCSMCSGKHLQSQLPGPRAATSWHRQRWLPVLELSFLVLRASLYKKERDEEQDIITEPAVSPCTASV

SEQ ID NO: 878005 - protein, 88 aa, Homo sapiens
MGVREGAQALSRYGNERKYPGPAQGSVLGVPRPLLTGSEPVARVWPGHLCLSCLQVSSYGGTLRYELHSETQRGDVFVPMESRPDVVL

SEQ ID NO: 878006 - protein, 195 aa, Homo sapiens
MSQTGHLGLANASAPSGEQLLRTLAEVERLLWEMRARDLGAPQAAAEAELAAAQRCGGVVPGRRGGERQGPGSSKGEVSMEWHQVGITGQMDLAGTKWRPGVMKGPGFQSDHPHLVSASAVARVQEQLSSLWEENQALATQTRDRLAQHEAGLMDLREALNRAVDATREAQELNSRNQERLEEALVRTPDLFFLL

SEQ ID NO: 878007 - protein, 790 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 878008 - protein, 790 aa, Homo sapiens; identical to SEQ ID NO: 878007

SEQ ID NO: 878009 - protein, 790 aa, Homo sapiens; identical to SEQ ID NO: 878007

SEQ ID NO: 878010 - protein, 723 aa, Homo sapiens
MQKIYESSARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 878011 - protein, 590 aa, Homo sapiens
MYLRRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 878012 - protein, 790 aa, Homo sapiens; identical to SEQ ID NO: 878007

SEQ ID NO: 878013 - protein, 790 aa, Homo sapiens; identical to SEQ ID NO: 878007

SEQ ID NO: 878014 - protein, 788 aa, Homo sapiens [sequence omitted]

SEQ ID NO: 878015 - protein, 790 aa, Homo sapiens; identical to SEQ ID NO: 878007

SEQ ID NO: 878016 - protein, 790 aa, Homo sapiens; identical to SEQ ID NO: 878007

SEQ ID NO: 878017 - protein, 759 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQVSWLGTFIHKRKQYISLVLVFKNVIFHCKRNTHSFIEEIKNTKI

SEQ ID NO: 878018 - protein, 790 aa, Homo sapiens; identical to SEQ ID NO: 878007

SEQ ID NO: 878019 - protein, 790 aa, Homo sapiens; identical to SEQ ID NO: 878007

SEQ ID NO: 878020 - protein, 759 aa, Homo sapiens; identical to SEQ ID NO: 878017

SEQ ID NO: 878021 - protein, 91 aa, Homo sapiens
GPSKRFYATMPAYDLPPIRMPCFASQASTSPQAQLIHEVLTDSSPHPQEELALSSSAPIPCLVETLNLAAVQGQESLAVEDAGFWKGTKKS

SEQ ID NO: 878022 - protein, 194 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCNLCLLGKFHSQAAALPDSVQSKAIISGELPLTPPSSHLQKCKSWAPTGCLGACIEAVGRNQRPLWYCWTPAAKGQKGETTGRLGKQREATLFPVEWRMLGCCCSGRQRPFA

SEQ ID NO: 878023 - protein, 926 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 878024 - protein, 926 aa, Homo sapiens; identical to SEQ ID NO: 878023

SEQ ID NO: 878025 - protein, 909 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 878026 - protein, 817 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQHHRHELTGRPPGGHLCRPPALLHLFLLGPELPKLHHTGELQLRALRWP

SEQ ID NO: 878027 - protein, 269 aa, Homo sapiens [sequence omitted]

SEQ ID NO: 878028 - protein, 256 aa, Homo sapiens
MENLCLGLFLPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 878029 - protein, 555 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 878030 - protein, 173 aa, Homo sapiens
GSRRGGRDRERGTSLQPAPSTSSAAQTLGEVEVRAGASELGEGLAHSQAIPAATAAAPAAATAAAASFLRLPSRGWPSGCSRWGRLPPGEPGEDKSRAAAFHSGCPAAAASARVSVKGAAGCVSVYASEITQLPGGRVMPKASLGFNYYYYHYCYAWLSGNTRDICRIKEMTL

SEQ ID NO: 878031 - protein, 117 aa, Homo sapiens [sequence omitted]

SEQ ID NO: 878032 - protein, 119 aa, Homo sapiens [sequence omitted]

SEQ ID NO: 878033 - protein, 926 aa, Homo sapiens; identical to SEQ ID NO: 878023

SEQ ID NO: 878034 - protein, 774 aa, Homo sapiens
MGTVNPQTSWANTVGTSPRPPSSPRAPCSTSSSPPTTPGRGQASLCATRSSRQALKIAQKTSQAPTGPSNLLGFLRSIHTTWTSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 878035 - protein, 654 aa, Homo sapiens
MAQIANEQISASSTSHQSRKISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 878036 - protein, 901 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 878037 - protein, 826 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADFKGKKKFFFCMLFPSPM

SEQ ID NO: 878038 - protein, 147 aa, Homo sapiens
GSRRGGRDRERGTSLQPAPSTSSAAQTLGEVEVRAGASELGEGLAHSQAIPAATAAAPAAATAAAASFLRLPSRGWPSGCSRWGRLPPGEPGEDKSRAAAFHSGCPAAAASARVSVKGAAGCVSVYASEITQLPGGRVMPKELLSSW

SEQ ID NO: 878039 - protein, 552 aa, Homo sapiens
MTRGGPGGRPGLPQPPPLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNIIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMAEVYNFDFITMKPILKLDIK

SEQ ID NO: 878040 - protein, 300 aa, Homo sapiens [sequence omitted]

SEQ ID NO: 878041 - protein, 186 aa, Homo sapiens
MDNISFALSPFLSPSLSIPPLLPFHSKSGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMAEVYNFDFITMKPILKLDIK

SEQ ID NO: 878042 - protein, 104 aa, Homo sapiens [sequence omitted]

SEQ ID NO: 878043 - protein, 440 aa, Homo sapiens
MNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNIIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMAEVYNFDFITMKPILKLDIK

SEQ ID NO: 878044 - protein, 236 aa, Homo sapiens
GSPIWSASVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMAEVYNFDFITMKPILKLDIK

SEQ ID NO: 878045 - protein, 188 aa, Homo sapiens
MTRGGPGGRPGLPQPPPLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKVGL

SEQ ID NO: 878046 - protein, 1119 aa, Homo sapiens
MKCSLRKMWRPGEKKEPQGVVYEDVPDDTEDFKESLKVVFEGSAYGLQNFNKQKKLKTCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLNKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 878047 - protein, 597 aa, Homo sapiens
MGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 878048 - protein, 426 aa, Homo sapiens
LYRIIRVSGKYNINNIFRLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 878049 - protein, 721 aa, Homo sapiens
MQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 878050 - protein, 142 aa, Homo sapiens [sequence omitted]

SEQ ID NO: 878051 - protein, 810 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878052 - protein, 772 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISVSRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878053 - protein, 735 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVSRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878054 - protein, 594 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVKIQRRKVVQIKKSCLQSSTKQLFPDLQTL

SEQ ID NO: 878055 - protein, 678 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSSSAIFFFGMDSLQMTPCKN

SEQ ID NO: 878056 - protein, 772 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFR

SEQ ID NO: 878057 - protein, 343 aa, Homo sapiens
MIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878058 - protein, 381 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKAKMRHPQVETSQ

SEQ ID NO: 878059 - protein, 445 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRYLYKVKI

SEQ ID NO: 878060 - protein, 213 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLQSRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESSMDLPIYED

SEQ ID NO: 878061 - protein, 810 aa, Homo sapiens; identical to SEQ ID NO: 878051

SEQ ID NO: 878062 - protein, 820 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSGVQGDAGKRGESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878063 - protein, 823 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRYLYKDEDLKKASLTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 878064 - protein, 244 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESSMDLPIYED

SEQ ID NO: 878065 - protein, 772 aa, Homo sapiens; identical to SEQ ID NO: 878056

SEQ ID NO: 878066 - protein, 731 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGSGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQG

SEQ ID NO: 878067 - protein, 445 aa, Homo sapiens; identical to SEQ ID NO: 878059

SEQ ID NO: 878068 - protein, 202 aa, Homo sapiens
RERALGGGHCEAAACGSAGSRAPGARASAMAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTDSVSSLVSQVTDPCSILIHVQPRRKTVTLGPGPQRMHILSFR

SEQ ID NO: 878069 - protein, 99 aa, Homo sapiens
RGRNWRTAAHFRRGGHGVRLSPRYCLPGMDPGARRGVPEELGTPKAFHRCGPVLSQLEGGSHGILLVSTTSSPFSGAGGASEVLWSVGWDQFVSVKSKL

SEQ ID NO: 878070 - protein, 99 aa, Homo sapiens; identical to SEQ ID NO: 878069

SEQ ID NO: 878071 - protein, 252 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFRETHALYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 878072 - protein, 403 aa, Homo sapiens
MQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 878073 - protein, 593 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 878074 - protein, 543 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRYDVFQGSSSVLLLIKMAISIFAAQ

SEQ ID NO: 878075 - protein, 631 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLRWCLALLSRLERDLGSLQPPPAGFKRFSCLSLPSSWDYSHLAAVAHKTLQIKDSPPEVAGARLHLFKAVRSVLANGMKLLGITPVCRM

SEQ ID NO: 878076 - protein, 543 aa, Homo sapiens; identical to SEQ ID NO: 878074

SEQ ID NO: 878077 - protein, 531 aa, Homo sapiens
RGRNWRTAAHFRRGGHGVRLSPRYCLPAFQSVESSTRKLDHINICSSNFPKRTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 878078 - protein, 487 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHR

SEQ ID NO: 878079 - protein, 437 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKSEFSFFLLKS

SEQ ID NO: 878080 - protein, 265 aa, Homo sapiens
MRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 878081 - protein, 99 aa, Homo sapiens; identical to SEQ ID NO: 878069

SEQ ID NO: 878082 - protein, 193 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGKCLVSHKMLNVPLRKYLIVQFNVLMLK

SEQ ID NO: 878083 - protein, 593 aa, Homo sapiens; identical to SEQ ID NO: 878073

SEQ ID NO: 878084 - protein, 187 aa, Homo sapiens
RGRNWRTAAHFRRGGHGVRLSPRYCLPAFQSVESSTRKLDHINICSSNFPKRAGVQWHNLDSLQSPPPGFKRFPCLSLPSSWDCREVADFQLSVDSLLEKDNDHSRPDIQVQAKRLAEKLRCDTVVSEISTGQRTVNFKINRELLTKTVLQQVIEDGSKYGLKSELFSGLPQKKIVVEFRVARPLYK

SEQ ID NO: 878085 - protein, 593 aa, Homo sapiens; identical to SEQ ID NO: 878073

SEQ ID NO: 878086 - protein, 593 aa, Homo sapiens; identical to SEQ ID NO: 878073

SEQ ID NO: 878087 - protein, 403 aa, Homo sapiens; identical to SEQ ID NO: 878072

SEQ ID NO: 878088 - protein, 540 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLSRRGAVYNHLVSSLVHLSLLDP

SEQ ID NO: 878089 - protein, 403 aa, Homo sapiens; identical to SEQ ID NO: 878072

SEQ ID NO: 878090 - protein, 452 aa, Homo sapiens
EAGTGGLRRTSVEVDMACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQVC

SEQ ID NO: 878091 - protein, 265 aa, Homo sapiens; identical to SEQ ID NO: 878080

SEQ ID NO: 878092 - protein, 99 aa, Homo sapiens; identical to SEQ ID NO: 878069

SEQ ID NO: 878093 - protein, 1152 aa, Homo sapiens
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878094 - protein, 158 aa, Homo sapiens
AWAPLVQLRKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQVRRGVGV

SEQ ID NO: 878095 - protein, 1179 aa, Homo sapiens
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKWVQRRVSSVGGGGWQGRPHVSVLPPPRCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878096 - protein, 975 aa, Homo sapiens
AWAPLVQLRKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKWVQRRVSSVGGGGWQGRPHVSVLPPPRCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878097 - protein, 1237 aa, Homo sapiens
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKWVQRRVSSVGGGGWQGRPHVSVLPPPRCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKVRWDPLWGGGVDEGTEFKLQPHTGCVLEHEVAHGQSGLQVPALTTSTQGPLLMRFPLQRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878098 - protein, 1187 aa, Homo sapiens
MRPRGAAFAAGPPGDLHLGTAIGFAGAIWRSRSPAMSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878099 - protein, 1196 aa, Homo sapiens
MSTLLDIKSSVLRQVQVCPSFRRRTEQDPGSASADPQEPATGAWKPGDGVEFFAHMRLMLKKGEGRQGLPCLEAWGSPCRQSPHPGPHTQVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPIEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKWVQRRVSSVGGGGWQGRPHVSVLPPPRCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 878100 - protein, 1179 aa, Homo sapiens; identical to SEQ ID NO: 878095

SEQ ID NO: 878101 - protein, 1179 aa, Homo sapiens; identical to SEQ ID NO: 878095

SEQ ID NO: 878102 - protein, 2843 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKDFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 878103 - protein, 2843 aa, Homo sapiens; identical to SEQ ID NO: 878102

SEQ ID NO: 878104 - protein, 2893 aa, Homo sapiens
AGSGPGAADRGWLDAVPRYCCWLLVRKVKHSVAFSGLGAPYVRLPGLGSGRPFARFCTTLSSRVLEHRRHRSCVRQETKSPGGARTSGHWASVWQEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKDFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 878105 - protein, 2843 aa, Homo sapiens; identical to SEQ ID NO: 878102

SEQ ID NO: 878106 - protein, 591 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKVPLKTFSTII

SEQ ID NO: 878107 - protein, 2843 aa, Homo sapiens; identical to SEQ ID NO: 878102

SEQ ID NO: 878108 - protein, 2771 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRKEALLPIHIQTLTISLSRKIQIGHVLMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKDFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 878109 - protein, 788 aa, Homo sapiens
MAAASYDQLLKQVEALKMENSNLRQELEDNSNHLTKLETEASNMKEVLKQLQGSIEDEAMASSGQIDLLERLKASDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 878110 - protein, 617 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKRWSLALLPGWSAVAGSRLTATSNSLVQAIILPQPPK

SEQ ID NO: 878111 - protein, 256 aa, Homo sapiens
MSTRRVRGGGGAREEEKQERPESNARRQEEGGRRQHKQKQEEEGERRRGAKNTTQGGGRTRARRGGHNNGGSTEQQGRGSKDSRAARGEAGESKRERREGTSQGVEEARAQQKTGSRREQAQESRARPERTRRGKRREGETKSREASSGRGKKAQSSNNRRGRTKKIERREGKRRRTEGEKTREREEEEGRRRRGRRKGAGREEEEGGRERRRERRGRPGARDERRARETTKSSRQSTTTHTTEEAPSHKKTPHSQ

SEQ ID NO: 878112 - protein, 301 aa, Homo sapiens
EPGNCCCPGKRLRAEGGRTAQLTAVLRKFLDPRLISTEENTQAAETMGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSVHQLPFRR

SEQ ID NO: 878113 - protein, 301 aa, Homo sapiens; identical to SEQ ID NO: 878112

SEQ ID NO: 878114 - protein, 301 aa, Homo sapiens; identical to SEQ ID NO: 878112

SEQ ID NO: 878115 - protein, 301 aa, Homo sapiens; identical to SEQ ID NO: 878112

SEQ ID NO: 878116 - protein, 156 aa, Homo sapiens
GLQANITMYSCPQLSNLVFLLPQKLKKDEASPCSAPFTLNLLPKLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSVHQLPFRR

SEQ ID NO: 878117 - protein, 132 aa, Homo sapiens
VTRGRSDYAVTDYAARSDYSVETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSVHQLPFRR

SEQ ID NO: 878118 - protein, 301 aa, Homo sapiens; identical to SEQ ID NO: 878112

SEQ ID NO: 878119 - protein, 248 aa, Homo sapiens
EPGNCCCPGKRLRAEGGRTAQLTAVLRKFLDPRLISTEENTQAAETMGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNDGPDLPRIHPSVHQLPFRR

SEQ ID NO: 878120 - protein, 289 aa, Homo sapiens
EPGNCCCPGKRLRAEGGRTAQLTAVLRKFLDPRLISTEENTQAAETMGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLREYLLFL

SEQ ID NO: 878121 - protein, 197 aa, Homo sapiens
EPGNCCCPGKRLRAEGGRTAQLTAVLRKFLDPRLISTEENTQAAETMGPLSAPPCTEHIKWKGLLVTVETPKPSISSSNLNPREAMETVILTCDPETPDTSYQWWMNGQSLPMTHRFQLSETNRTLFLFGVTKYTAGPYECEIRNSGSASRSDPVTLNLLHGPDLPKNSPSLHQLPSEIPTCERPYHVRDLHGETYM

SEQ ID NO: 878122 - protein, 246 aa, Homo sapiens
AEGGRTAQLTAVLWKLLDPRLISTEENMHAAEIMGPLSAPPCTEHIKWKGLLLTVETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFADSNPPAQYSWTINGKFQLSGQKLFIPQITPKHNGLYACSARNSATGEESSTSLTIRVIAPPGLGTFAFNNPT

SEQ ID NO: 878123 - protein, 109 aa, Homo sapiens
LRGSLCPFKRPGASPSLRWHHLWLYSLCSRWSRPPQNSPFSTPITVQEITSTCLASRTLTHRHSILGQLMGSFSNQDKICLSPKLLQSIAGSMFALFVTQPLARKAPHR

SEQ ID NO: 878124 - protein, 135 aa, Homo sapiens
RLGTRLTTRLGYFTFTLHLETPKPSISSSNLNPREAMETVILTCDPETPDTSYQWWMNGQSLPMTHRFQLSETNRTLFLFGVTKYTAGPYECEIRNSGSASRSDPVTLNLLHGSDLPRIHPSYLNHHQYLSGTSR

SEQ ID NO: 878125 - protein, 301 aa, Homo sapiens; identical to SEQ ID NO: 878112

SEQ ID NO: 878126 - protein, 301 aa, Homo sapiens; identical to SEQ ID NO: 878112

SEQ ID NO: 878127 - protein, 301 aa, Homo sapiens; identical to SEQ ID NO: 878112

SEQ ID NO: 878128 - protein, 130 aa, Homo sapiens
RLGTRLTTRLGYFTFTLHLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSVHQLPFRR

SEQ ID NO: 878129 - protein, 271 aa, Homo sapiens
EPGNCCCPGKRLRAEGGRTAQLTAVLRKFLDPRLISTEENTQAAETMGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRGPSFYLVSQSILQDPMNVKYGTQGVPAAVTQSP

SEQ ID NO: 878130 - protein, 91 aa, Homo sapiens
LAFTCEPKSESYTYIWWLNGQSLPVSPRVKRPIENRILILPSVTRNETGPYECEIRDRYGGIHSDPVTLNVLYGPDLPRIHPSVHQLPFRR

SEQ ID NO: 878131 - protein, 131 aa, Homo sapiens
EPGNCCCPGKRLRAEGGRTAQLTAVLRKFLDPRLISTEENTQAAETMGPLSAPPCTEHIKWKGLLVTATQEAAAGESREPRRQKLQRAEIAPLHTSLGDSTRLRLKKKKKKKKKKKEKKEIKGKKALLEPG

SEQ ID NO: 878132 - protein, 123 aa, Homo sapiens
SLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYRK

SEQ ID NO: 878133 - protein, 80 aa, Homo sapiens
NGLVRGRSTPTGRHQRECGHNHHVTAHRHQRECSRNRHVTAHRRPGAPLRPKLASGAANEKGACLAPAGLQSSRSAPARG

SEQ ID NO: 878134 - protein, 164 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNAPGEPSPNKAGGLRRAQGWTSLCNEHPNDHTRACGGRGPQDTETGRDEARDSHRRGSVAHTAKTRQA

SEQ ID NO: 878135 - protein, 490 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878136 - protein, 490 aa, Homo sapiens; identical to SEQ ID NO: 878135

SEQ ID NO: 878137 - protein, 490 aa, Homo sapiens; identical to SEQ ID NO: 878135

SEQ ID NO: 878138 - protein, 490 aa, Homo sapiens; identical to SEQ ID NO: 878135

SEQ ID NO: 878139 - protein, 439 aa, Homo sapiens
PVSLVWVQQDPAELSFPQPSTPQSPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878140 - protein, 517 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGELGPNWGWSGPGGTQPGPWSLPLLVTGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878141 - protein, 477 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHSYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878142 - protein, 490 aa, Homo sapiens; identical to SEQ ID NO: 878135

SEQ ID NO: 878143 - protein, 302 aa, Homo sapiens [sequence omitted]

SEQ ID NO: 878144 - protein, 490 aa, Homo sapiens; identical to SEQ ID NO: 878135

SEQ ID NO: 878145 - protein, 413 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFGLRSQLEAIFLRDWDSPYSHDLDTSADSVGNACRLL

SEQ ID NO: 878146 - protein, 503 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRTQARIPYARVNHNKYMVTERATYIDLPLSGNLLSGTA

SEQ ID NO: 878147 - protein, 400 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHSYERGVKVRLLISCWGHSEPSMRAFGLRSQLEAIFLRDWDSPYSHDLDTSADSVGNACRLL

SEQ ID NO: 878148 - protein, 177 aa, Homo sapiens
GCGGPQPIVNGRPEPVRVGELQSGQELFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878149 - protein, 172 aa, Homo sapiens
MRVTNYDDEAFGKGFDDPSIGVFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878150 - protein, 409 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWAPADPGALGHGPCPRTPASVCPIVAPQALSPALPPLPPPPPA

SEQ ID NO: 878151 - protein, 225 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHQPPKKWGCMLGLAPWPTPTFQGKKGPGL

SEQ ID NO: 878152 - protein, 275 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSELGPNWGWSGPGGTQPGPWSLPLLVTGAQVRMVDMQKLTHGVLHTKFWVVDQTHFYLGSANMDWRSLTQVCLHPVYLPSRPLPAPQGTQPPTASLTQSRVLSTHSL

SEQ ID NO: 878153 - protein, 159 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLVPELAARP

SEQ ID NO: 878154 - protein, 490 aa, Homo sapiens; identical to SEQ ID NO: 878135

SEQ ID NO: 878155 - protein, 490 aa, Homo sapiens; identical to SEQ ID NO: 878135

SEQ ID NO: 878156 - protein, 490 aa, Homo sapiens; identical to SEQ ID NO: 878135

SEQ ID NO: 878157 - protein, 472 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878158 - protein, 490 aa, Homo sapiens; identical to SEQ ID NO: 878135

SEQ ID NO: 878159 - protein, 490 aa, Homo sapiens; identical to SEQ ID NO: 878135

SEQ ID NO: 878160 - protein, 502 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSELGPNWGWSGPGGTQPGPWSLPLLVTGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878161 - protein, 290 aa, Homo sapiens
MNEIEAWKAAEKKARWVLLVLILAVVGFGALMTQLFLWEYGDLHLFGPNQRPAPCYDPCEEVLVEGIPWGPEYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878162 - protein, 129 aa, Homo sapiens
MRKAHAWPPPACSLAVVRLRAARRGRQAGIQPGRCVWGWVSEWETWSAGWNVAKPIHQPCTTPQPGQAGATVSGEPSPASRCGEPGLGHALRRLPAAVGGAPTGPAPSSHPRSACPDRSWGPAEVAADA

SEQ ID NO: 878163 - protein, 129 aa, Homo sapiens; identical to SEQ ID NO: 878162

SEQ ID NO: 878164 - protein, 476 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGAIRVARCVALRGARGVLTCSVSDLGHCLHGAPSLRHPRCHTKSRYRA

SEQ ID NO: 878165 - protein, 175 aa, Homo sapiens
MVHKFTRFVNEKRREVPFVLYLWPPFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878166 - protein, 129 aa, Homo sapiens
MLGLLLQNNKQRTQNAPNIRRVLRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 878167 - protein, 140 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTPALPPLPPPPPA

SEQ ID NO: 878168 - protein, 129 aa, Homo sapiens; identical to SEQ ID NO: 878162

SEQ ID NO: 878169 - protein, 321 aa, Homo sapiens
MATRRLTDAFLLLRNNSIQNRQLLAEQVSSHITSSPLHSRSIAALADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQMVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 878170 - protein, 274 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQMVQSISDLNEIFRDLGAMIVEQGTVLDRIDYNVEQSCIKTEDGLKQLHKAGYEEETQNNRSGLWNYMEVTEEGTNQRPLSNQDVG

SEQ ID NO: 878171 - protein, 117 aa, Homo sapiens
QIRGWREPEKRSEKAGEAGPAVFLQAGSLLAVEDQAVQERKGSGGRAGPQQVQTSPQKGAAGALESRPQAWLRLSKEGLGQASGAETESQPDLRARPRRLRAKVRGREQRPPGGLRE

SEQ ID NO: 878172 - protein, 272 aa, Homo sapiens
MALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQMVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 878173 - protein, 139 aa, Homo sapiens
MKNREERSQHFFDTSVPLMDDGDDNTLYHRGFTEDQLVLVEQNTLMVEEREREIRQMVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 878174 - protein, 166 aa, Homo sapiens
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 878175 - protein, 119 aa, Homo sapiens
ENSVFFRKRNGGCDRLPVVKRLKGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 878176 - protein, 166 aa, Homo sapiens; identical to SEQ ID NO: 878174

SEQ ID NO: 878177 - protein, 166 aa, Homo sapiens; identical to SEQ ID NO: 878174

SEQ ID NO: 878178 - protein, 479 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878179 - protein, 488 aa, Homo sapiens
PSDHRTGLGRDVGAGARRAARCRAEAAAAVGTARSPALGMALLVLGLVSCTFFLAVNGLYSSSDDVIELTPSNFNREVADTFIPAVHQYLWALSAHSHSSHRCWVHLSTSIQPPSTWDSTSQHTAHLNTAYIVPQRFGAKLAMPSINKPIHFRISARVQVIGEVSSGHIHITHISTAFSGGIPTPHTHQQRSTGISPHRVGPGKLGWTGTIEVKNSVAAMAVGSCRPSHPSHRESQHRSGGNRTGRQGITKAMSRHNEPRGHSKVGIHGSTHVPPHAHSSPSASPATQARAPGIPAIQRTWLPWGNTTCTRPTHPGHSALARYLHGLPHGVAGNQLRADKTPYEHAHTQLGSTATPHTPHHRYNTRSQHTKQRDTPRSNTFATQILGLSLQPHTAPTHSRDVIMGSRLTPKHTRDPTEPSTSPQPNTRRRKQTHNQGAQINSDASSTPAGATHQLQATTNPAATTPTIRVAPRHVAQPNQHDGTHLHP

SEQ ID NO: 878180 - protein, 474 aa, Homo sapiens
PFICSRPCTNCTVTGPGILLRLPILYGLQYSALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878181 - protein, 259 aa, Homo sapiens
MVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878182 - protein, 388 aa, Homo sapiens
FNAVAALKDYTTSFNAVAALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878183 - protein, 343 aa, Homo sapiens
MRHLLKAGLRTAYLPSPVGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878184 - protein, 461 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878185 - protein, 479 aa, Homo sapiens; identical to SEQ ID NO: 878178

SEQ ID NO: 878186 - protein, 479 aa, Homo sapiens; identical to SEQ ID NO: 878178

SEQ ID NO: 878187 - protein, 479 aa, Homo sapiens; identical to SEQ ID NO: 878178

SEQ ID NO: 878188 - protein, 479 aa, Homo sapiens; identical to SEQ ID NO: 878178

SEQ ID NO: 878189 - protein, 474 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGEVSAREGSCAGSSPGLLS

SEQ ID NO: 878190 - protein, 471 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVDTESWHRPRLRLPLEYNLTPVIRIP

SEQ ID NO: 878191 - protein, 78 aa, Homo sapiens
PSDHRTGLGRDVGAGARRAARCRAEAAAAVGTARSPALGMALLVLGLVSCTFFLAVNGLYSSSDDVIELTPSNFNREV

SEQ ID NO: 878192 - protein, 334 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLRESLGTAGMASFPWRMTLTSVMWSLMT

SEQ ID NO: 878193 - protein, 397 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTDPTSFDNQPRQEHLHHGHPQMLQASTRLLMGESQESTDEENGCSIECQQL

SEQ ID NO: 878194 - protein, 84 aa, Homo sapiens
CQRYTCQNCVTPGEADSEVKTQSWAGQMRHLLKAGLRTAYLPSPVGGRTGEAIVDAALSALRQLVKDRLGGRSGGYSSGKQVRP

SEQ ID NO: 878195 - protein, 104 aa, Homo sapiens
WRAAQADPQSLLPGVPDMAWPSQMPMSPGSAVPLPLMGWQGQGGAVDRNKTGLGSSHALLLSGRLASGFPICSTAGIMPVLRADCARLLHIPSSQPHVVTPHQL

SEQ ID NO: 878196 - protein, 77 aa, Homo sapiens
QEDSWPSDPQKWIAEVGVPPRFHSGDNASAESRLCQAPSHSLLAAPRGDTPPALTTSHGRSIYTTAIHKCYRPAHGC

SEQ ID NO: 878197 - protein, 479 aa, Homo sapiens; identical to SEQ ID NO: 878178

SEQ ID NO: 878198 - protein, 403 aa, Homo sapiens
LRIKGFNGCFVLSSPKRCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878199 - protein, 388 aa, Homo sapiens
MSSCGVCFTEGKIVISFTFPQDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878200 - protein, 303 aa, Homo sapiens
MHDKRAEDTVLGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 878201 - protein, 431 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALGALFWAWLHGTCRRRGFPYHR

SEQ ID NO: 878202 - protein, 474 aa, Homo sapiens; identical to SEQ ID NO: 878189

SEQ ID NO: 878203 - protein, 479 aa, Homo sapiens; identical to SEQ ID NO: 878178

SEQ ID NO: 878204 - protein, 425 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLR

SEQ ID NO: 878205 - protein, 373 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGF

SEQ ID NO: 878206 - protein, 159 aa, Homo sapiens
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGKDFS

SEQ ID NO: 878207 - protein, 508 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878208 - protein, 89 aa, Homo sapiens
RHETVLRFDTTNDYCHIVGPRSCIGEILARQELFLIMAWLLQRFDLEVPDDGQLPSLEGIPKVVFLIDSFKVKIKVRQAWREAQAEGST

SEQ ID NO: 878209 - protein, 508 aa, Homo sapiens; identical to SEQ ID NO: 878207

SEQ ID NO: 878210 - protein, 493 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENSVMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878211 - protein, 479 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878212 - protein, 508 aa, Homo sapiens; identical to SEQ ID NO: 878207

SEQ ID NO: 878213 - protein, 508 aa, Homo sapiens; identical to SEQ ID NO: 878207

SEQ ID NO: 878214 - protein, 508 aa, Homo sapiens; identical to SEQ ID NO: 878207

SEQ ID NO: 878215 - protein, 508 aa, Homo sapiens; identical to SEQ ID NO: 878207

SEQ ID NO: 878216 - protein, 224 aa, Homo sapiens
RHVVWDERLGAPCSNQLQHAHNMRCSSKRTPTYTARHQSPQTQVFRQKRLLGGKGWRRAGFRFDLAEAEEMRGHEAEQGREYEVPDPLFLFHSGGSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878217 - protein, 508 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVNCNSQPLSTLCGPTTQI

SEQ ID NO: 878218 - protein, 542 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVNPKAVLNSPGHPMVAHNTELEFKPPTLFRNLFLFSTQSSFLFNFVEWQRWA

SEQ ID NO: 878219 - protein, 479 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILAPRDLSIMPAVERSTPGPNKGTCLLEASKGGF

SEQ ID NO: 878220 - protein, 430 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWAEGIPKVVFLIDSFKVKIKVRQAWREAQAEGST

SEQ ID NO: 878221 - protein, 265 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYRRNSGVTLSPTCWTH

SEQ ID NO: 878222 - protein, 262 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKTFPNITLQTLKSHVPQPSGGEAHTLPGRFNFALFPGWIQE

SEQ ID NO: 878223 - protein, 88 aa, Homo sapiens
ETFESTQLFYSTAVYLACRHPATMWELVALLLLTLAYLFWPKRRCPGAKYPKSLLSEGIPKVVFLIDSFKVKIKVRQAWREAQAEGST

SEQ ID NO: 878224 - protein, 118 aa, Homo sapiens
IGGKGLALQIWGCGEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878225 - protein, 508 aa, Homo sapiens; identical to SEQ ID NO: 878207

SEQ ID NO: 878226 - protein, 490 aa, Homo sapiens
MWELVALLLLTLAYLFWPKRRCPGAKYPKSLLSLPLVGSLPFLPRHGHMHNNFFKLQNGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878227 - protein, 461 aa, Homo sapiens
MWELVALLLLTLAYLFWPKRRCPGAKYPKSLLSLPLVGSLPFLPRHGHMHNNFFKLQNGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878228 - protein, 508 aa, Homo sapiens; identical to SEQ ID NO: 878207

SEQ ID NO: 878229 - protein, 508 aa, Homo sapiens; identical to SEQ ID NO: 878207

SEQ ID NO: 878230 - protein, 508 aa, Homo sapiens; identical to SEQ ID NO: 878207

SEQ ID NO: 878231 - protein, 140 aa, Homo sapiens
WAVGIRHYVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 878232 - protein, 219 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 878233 - protein, 219 aa, Homo sapiens; identical to SEQ ID NO: 878232

SEQ ID NO: 878234 - protein, 219 aa, Homo sapiens; identical to SEQ ID NO: 878232

SEQ ID NO: 878235 - protein, 189 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDGPPAAP

SEQ ID NO: 878236 - protein, 201 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAALPKNDLLQRLDALVAEEHLTVDARVYSYALALKHANAKPFEVPFLKF

SEQ ID NO: 878237 - protein, 219 aa, Homo sapiens; identical to SEQ ID NO: 878232

SEQ ID NO: 878238 - protein, 219 aa, Homo sapiens; identical to SEQ ID NO: 878232

SEQ ID NO: 878239 - protein, 238 aa, Homo sapiens
MESQEPTESSQNGKQYIISEELISEGKWVKLEKTTYMDPTGKTRTWESVKRTTRKEQTADGRSANLFQPFRKEVSTCDLGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 878240 - protein, 234 aa, Homo sapiens [sequence omitted]

SEQ ID NO: 878241 - protein, 234 aa, Homo sapiens [sequence omitted]

SEQ ID NO: 878242 - protein, 135 aa, Homo sapiens
GQVSWATWLSPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 878243 - protein, 182 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGQGMEVCSATPGGRACMT

SEQ ID NO: 878244 - protein, 182 aa, Homo sapiens; identical to SEQ ID NO: 878243

SEQ ID NO: 878245 - protein, 205 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDKKIKKKKKKKKKKKKIKNKGEKKKKKKKGFVEPPPTPQPDLGGPVDRPPPPNPFGVFFYVLFFTGHFCKRDHQAFFTKTLYST

SEQ ID NO: 878246 - protein, 219 aa, Homo sapiens
MESQEPTESSQNGKQYIISEELISEGKWVKLEKTTYMDPTGKTSVWDGTFSAFPSTVFFSLYGLTLGGSRESYAKRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGMCVSAVMKVVWLHYVSWNLLLV

SEQ ID NO: 878247 - protein, 219 aa, Homo sapiens; identical to SEQ ID NO: 878232

SEQ ID NO: 878248 - protein, 216 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPF

SEQ ID NO: 878249 - protein, 219 aa, Homo sapiens; identical to SEQ ID NO: 878232

SEQ ID NO: 878250 - protein, 216 aa, Homo sapiens; identical to SEQ ID NO: 878248

SEQ ID NO: 878251 - protein, 133 aa, Homo sapiens
MGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 878252 - protein, 232 aa, Homo sapiens
MESQEPTESSQNGKQYIISEELISEGKWVKLEKTTYMDPTGKTRRNKEKTTTLLILRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 878253 - protein, 186 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDETL

SEQ ID NO: 878254 - protein, 232 aa, Homo sapiens; identical to SEQ ID NO: 878252

SEQ ID NO: 878255 - protein, 187 aa, Homo sapiens
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGMCVSAVMKVVWLHYVSWNLLLV

SEQ ID NO: 878256 - protein, 216 aa, Homo sapiens; identical to SEQ ID NO: 878248

SEQ ID NO: 878257 - protein, 80 aa, Homo sapiens
GVSNRGKPVTAQNLFGEEKKKGKGTTSAWCVQPRGVSQAAAGHASRRPRGKLGIGGKLWIGEEEPGLLRVKKAGNTTAKC

SEQ ID NO: 878258 - protein, 113 aa, Homo sapiens
KLPARETRRFGAAAVSSGAPTGLCAGVPPPAVSFILLSHPTIYLNGYKVHVISLSTLSILAHCILDFKISDAKYADTFVEEIWALSICKIFVGRFCLVLLTDVLLFFMARENY

SEQ ID NO: 878259 - protein, 160 aa, Homo sapiens [sequence omitted]

SEQ ID NO: 878260 - protein, 113 aa, Homo sapiens; identical to SEQ ID NO: 878258

SEQ ID NO: 878261 - protein, 430 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVCG

SEQ ID NO: 878262 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 878263 - protein, 2234 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNFYKKIFKHFNGKLELLIIAPKDYNFKSHRRRQIAHGHASCWLYTRTKTDKYPHHDVTHIAADFFREKCVLLLFETSVVVALYCNDITYLDQHENVDPLKSTDYTLQVPVIPTLPRENNAVREFSIVSLQGYSNPCTGHVRKKIIWQVYSKVAKHFNSWWLNRQEQLDEEMIRVSLFQEVNRYNLNLKRLLLFKVCSFMHVCLWFAYFCKMDTNSSISLLFAFMFCFLFYRISLCMSQMTGLIKCYSYYCHKKLIIQCHFIRILVLKAEMLIGDTVKYHQNLNSFIVHKCGVLYPLPGKLKGLFGHFIYLIINSQDELEILPQAKYHILNVFLDFDCSRYQHFLNEKLYYLLPSRQPKDVLSQNHSNTFLPEFIKVQNWRIDDILEISFFFFFFFFGDGVSLLSPRLKCNGAIRVHCNLCLPGSSSSPASASWVAGITGIHHRAQLIFVFLVETGFCHVGQVDLKLLTSGDLPSSASQSVGITGMSHHARLLILLFSEFRELSLRKLKRFLRKHSSDKVATLERSFYLLIVRPVFIAQYHATSGIFKIFNWQMFFNVIYSCLKCMRKVQSKIERNNSNWIVHNQLPVFHANQLLKRLKYGIPTGEFLRTISLYEQCSLEFSSAQLETLIHGPCALSSPMEIYLHLPYPYGLSLILLARSLTVLCGYTVLPMTTKESIQKYLFFYNKLPRFAVFQHLSESTRYCILMKTNPISYSTLKRTEKPIISCSGANKHSSSVRCPLQPSNFNANLNCISFLKGEIDIIQYCESLDKKPLITKNNVKIGFSSLIHITFFLKRKMDGCLTTLQKKKVKIAIKMMTIFEMNIMIFMNNKQISVWNELSKNEYNKMKSLKIQSLYFFYTLTCCTNFIVDQGCYHRKGQTSLYGNSVLDDDCGYACKVLCLSFLFLLKKLIFKDCRACILLEYLISSCVMICEMRINICLVRIELNGKGTQGTLRLNNVCKESLFSTNMATGAFGDSLILNTINEILNLLTELRTCTTLLVLQHFCALKYVMIYKCAIHTLQHNICFVMHFISLGTPLHCSAHVFINICYIFGNLLIFIEVIDFSGGLNIKIKKKSKIKHSRYLWRQFSKTQHENLWMHEMQILQRMNLKYIFNIYLISTEDIFMQDKSQPSDTEIYYDEIMKNFLCRIIFFLEPGRVIRLKGFFFLFLLLFFPLTLPKRFPKASSLISLIGKITEFNGIMKFFIFQTSLIDLKAHLSLCPRTKTDPLKSKNSKFSQLFELLFILKDLEYICFHKSIKWNIVTWELNHVQIAFCYVDSIFNLQLSLFILTSRTPFYAMQTTEIIANILSNNFPFLLKFLYSKFLCITDYTYPYLYFIDSKTSLFQFNISEIVTFLATVGTSDAVFKIMLESNITLIQLYLNVYASRQILFSYKGFESPFMTKYEGENLRTIESRTTQHGAKLIISSDPAYLEFTKALSGPHLYFTCVRMISANPNLTNKKWVGMSTFH

SEQ ID NO: 878264 - protein, 2243 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNFYKKIFKHFNGKLELLIIAPKDYNFKSHRRRQIAHGHASCWLYTRTKTDKYPHHDVTHIAADFFREKCVLLLFETSVVVALYCNDITYLDQHENVDPLKSTDYTLQVPVIPTLPRENNAVREFSIVSLQGYSNPCTGHVRKKIIWQVYSKVAKHFNSWWLNRQEQLDEEMIRVSLFQEVNRYNLNLKRLLLFKVCSFMHVCLWFAYFCKMDTNSSISLLFAFMFCFLFYRISLCMSQMTGLIKCYSYYCHKKLIIQCHFIRILVLKAEMLIGDTVKYHQNLNSFIVHKCGVLYPLPGKLKGLFGHFIYLIINSQDELEILPQAKYHILNVFLDFDCSRYQHFLNEKLYYLLPSRQPKDVLSQNHSNTFLPEFIKVQNWRIDDILEISFFFFFFFFGDGVSLLSPRLKCNGAIRVHCNLCLPGSSSSPASASWVAGITGIHHRAQLIFVFLVETGFCHVGQVDLKLLTSGDLPSSASQSVGITGMSHHARLLILLFSEFRELSLRKLKRFLRKHSSDKVATLERSFYLLIVRPVFIAQYHATSGIFKIFNWQMFFNVIYSCLKCMRKVQSKIERNNSNWIVHNQLPVFHANQLLKRLKYGIPTGEFLRTISLYEQCSLEFSSAQLETLIHGPCALSSPMEIYLHLPYPYGLSLILLARSLTVLCGYTVLPMTTKESIQKYLFFYNKLPRFAVFQHLSESTRYCILMKTNPISYSTLKRTEKPIISCSGANKHSSSVRCPLQPSNFNANLNCISFLKGEIDIIQYCESLDKKPLITKNNVKIGFSSLIHITFFLKRKMDGCLTTLQKKKVKIAIKMMTIFEMNIMIFMNNKQISVWNELSKNEYNKMKSLKIQSLYFFYTLTCCTNFIVDQGCYHRKGQTSLYGNSVLDDDCGYACKVLCLSFLFLLKKLIFKDCRACILLEYLISSCVMICEMRINICLVRIELNGKGTQGTLRLNNVCKESLFSTNMATGAFGDSLILNTINEILNLLTELRTCTTLLVLQHFCALKYVMIYKCAIHTLQHNICFVMHFISLGTPLHCSAHVFINICYIFGNLLIFIEVIDFSGGLKNSLKICLCLKCSVYLWFIKIKKKSKIKHSRYLWSNFPKLNIKICGCMRCNPSKKNLKYIFNIYLISTEDIFMQDKSQPSDTEIYYDEIMKNFLCRIIFFLEPGRVIRLKGFFFLFLLLFFPLTLPKRFPKASSLISLIVKNNEFNGINEVLHFQTSLIDLKAHLSLCPWTKTDPLKSKNSKFSQLFELLFILKDLEYICFHKSIKGNIVTWELNHVQIAFCYVDSIFNLQLSLFILTSRTPFYAMQTTEIIANILSNNFPFLLKFLYSKFLCITDYTYPYLYFIDSKTSLFQFNISEIVTFLATVGTSDAVFKIMLESNITLIQLYLNVYASRQILFSYKGFESPFMTKYEGENLRTIESRTTQHGAKLIISSDPAYLEFTKALSGPHLYFTGVRMISANPNLTNKNG

SEQ ID NO: 878265 - protein, 1090 aa, Homo sapiens
MSPRLKCNGAIRVHCNLCLPGSSSSPASASWVAGITGIHHRAQLIFVFLVETGFCHVGQVDLKLLTSGDLPSSASQSVGITGMSHHARLLILLFSEFRELSLRKLKRFLRKHSSDKVATLERSFYLLIVRPVFIAQYHATSGIFKIFNWQMFFNVIYSCLKCMRKVQSKIERNNSNWIVHNQLPVFHANQLLKRLKYGIPTGEFLRTISLYEQCSLEFSSAQLETLIHGPCALSSPMEIYLHLPYPYGLSLILLARSLTVLCGYTVLPMTTKESIRNIFFFIINFQDLLSSSTSVKVLDDCILMKTNPISYSTLKRTEKPIISCSGANKHSSSVRCPLQPSNFNANLNCISFLKGEIDIIQYCESLDKKPLITKNNVKIGFSSLIHITFFLKRKMDGCLTTLQKKKVKIAIKMMTIFEMNIMIFMNNKQISVWNELSKKEYNKMKSLKIQSLYFFYTLTCCTNFIVDQGCYHRKGQTSLYGNSVLDDDCGYACKVLCLSFLFLLKKLIFKDCRACILLEYLISSCVMICEMRINICLVRIELNGKGTQGTLRLNNVCKESLFSTNMATGAFGDSLILNTINEILNCYRIENLNNTFSTAAFLCPKVCNDFINVPYIHYNITFALLCILFLWGHHCTAVHTIYKHLLYFWKLANIYKVIDFSGGLKNSLKICLCLKCSVYLWFIKIKKKSKIKHSRYLWSNFPKLNIKICGCMRCNPSKKNLKYIFNIYLISTEDIFMQDKSQPSDTEIYYDEIMKNFLCRIIFFLEPGRVIRLKGFFFLFLLLFFPLTLPKRFPKASSLISLIVKNNEFNGIMKVLHFQTSLIDLKAHLSLCPWTKTDPLKSKNSKFSQLFELLFILKDLEYICFHKSIKWNIVTWELNHVQIAFCYVDSIFNLQLSLFILTSRTPFYAMQTTEIIANILSNNFPFLLKFLYSKFLCITDYTYPYLYFIDSKTSLFQFNISEIVTFLATVGTSDAVFKIMLESNITLIQLYLNVYASRQILFSYKGFESPFMTKYEGEIYGQLSHAQLNMEPNCLSAQIPHILSLQKLFQVPIYTLRECEVISANPNLLTRMGRYVYVSLTNFYYFYSII

SEQ ID NO: 878266 - protein, 324 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMVMQQ

SEQ ID NO: 878267 - protein, 222 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCRYLGFDVDMLN

SEQ ID NO: 878268 - protein, 2243 aa, Homo sapiens; identical to SEQ ID NO: 878264

SEQ ID NO: 878269 - protein, 2243 aa, Homo sapiens; identical to SEQ ID NO: 878264

SEQ ID NO: 878270 - protein, 1080 aa, Homo sapiens
MFHSCHPGWSAMAQLGFTATSASRVQAVLLPQPPEVAGITGIHHRAQLIFVFLVETGFCHVGQVDLKLLTSGDLPSSASQSVGITGMSHHARLLILLFSEFRELSLRKLKRFLRKHSSDKVATLERSFYLLIVRPVFIAQYHATSGIFKIFNWQMFFNVIYSCLKCMRKVQSKIERNNSNWIVHNQLPVFHANQLLKRLKYGIPTGEFLRTISLYEQCSLEFSSAQLETLIHGPCALSSPMEIYLHLPYPYGLSLILLARSLTVLCGYTVLPMTTKESIRNIFFFIINFQDLLSSSTSVKVLDDCILMKTNPISYSTLKRTEKPIISCSGANKHSSSVRCPLQPSNFNANLNCISFLKGEIDIIQYCESLVIKKPLITKNNVKIGFSSLIHITFFLKRKMDGCLTTLQKKKVKIAIKMMTIFEMNIMIFMNNKQISVWNELSKKEYNKMKSLKIQSLYFFIPSLVCTNFIVDQGCYHEEGTNFLVGNSVLDDDCGYACKVLCLSFLFLLKKLIFKDCRACILLEYLISSCVMICEMRINICLVRIELNGKGTQGTLRLNNVCKESLFSTNMATGAFGDSLILNTINEILNCYRIENLNNTFSTAAFLCPKVCNDFINVPYIHYNITFALLCILFLWGHHCTAVQHVFINICYIFGNLLIFIEVIDFSGGLKNVTKNLIMSYNVQFIFGLLKLKKNLRLNTVDISGGNFPKLNIKICGCMRCNPSKNESEIYFNIYLISTEDIFMQDKSQPSDTEIYYDEIMKNFLCRIIFFLEPGRVDRLKGFFFLFLLLFFPLTLPKRFPKASSLISLIVKNNEFNGINEVLHFQTSLIDLKAHLSLCPWTKTDPLKSKNSKFSQLFELLFILKDLEYICFHKSIKGNIVTWELNHVQIAFCYVDSIFNLQLSLFILTSRTPFYAMQTTEIIANILSNNFPFLLKFLYSKFLCITDYTYPYLYFIDSKTSLFQFNISEIVTFLATVGTSDAVFKIMLESNITLIQLYLNVYASRQILFSYKGFESPFMTKYEGENLRTIESRTTQHGAKLIISSDPAYLEFTKALSGPHLYFTCVRMISANPNLTNKNG

SEQ ID NO: 878271 - protein, 769 aa, Homo sapiens; identical to SEQ ID NO: 878262

SEQ ID NO: 878272 - protein, 224 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 878273 - protein, 224 aa, Homo sapiens; identical to SEQ ID NO: 878272

SEQ ID NO: 878274 - protein, 225 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDTIATVILLSSN

SEQ ID NO: 878275 - protein, 123 aa, Homo sapiens
MCLPAAAVLMSCCMHLHPAVYACSVLMCLPACASLCDCLLGLVLSCCMLLVCCDLYCCVPCCVCVACACICTLTMLLVMPCDPVLAAYLRSLFWMAFLDKLANACCYLQSDHTGSCGQPKMQP

SEQ ID NO: 878276 - protein, 136 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTIQDDSKLYRYLKLFCCFFFFLIATAFLPCLSSLPKSDEF

SEQ ID NO: 878277 - protein, 267 aa, Homo sapiens
ALSRRRFRKRRPAGATFIPLHPPRTRSVVVAPARRGQAPRSAALETGTESIMGSTVPRSASVLLLLLLLRRAEQPCGAEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 878278 - protein, 172 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQVNKKISNIMLVYLKGGKKHNLISCTN

SEQ ID NO: 878279 - protein, 224 aa, Homo sapiens; identical to SEQ ID NO: 878272

SEQ ID NO: 878280 - protein, 136 aa, Homo sapiens
MKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 878281 - protein, 224 aa, Homo sapiens; identical to SEQ ID NO: 878272

SEQ ID NO: 878282 - protein, 224 aa, Homo sapiens; identical to SEQ ID NO: 878272

SEQ ID NO: 878283 - protein, 374 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWHSVDTSPGYHESDSKKSEDLSLCNVAEHSNTTEGPTGKQEGAQSAVPPPHTPPPPTPPPRPPPPPNPPTSPFTELDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 878284 - protein, 518 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 878285 - protein, 482 aa, Homo sapiens
MWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 878286 - protein, 113 aa, Homo sapiens
MGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 878287 - protein, 518 aa, Homo sapiens; identical to SEQ ID NO: 878284

SEQ ID NO: 878288 - protein, 482 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAAPSQTHRGSVLCILQSNQVDTQY

SEQ ID NO: 878289 - protein, 128 aa, Homo sapiens [sequence omitted]

SEQ ID NO: 878290 - protein, 517 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEQDSFAVHPVEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 878291 - protein, 521 aa, Homo sapiens
VGPSGPSRRPWRRWWNTRASGPATTAATCDSKEGKASCGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 878292 - protein, 518 aa, Homo sapiens; identical to SEQ ID NO: 878284

SEQ ID NO: 878293 - protein, 343 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEIKKLLLGKLKRENRLNPGRRGCRELRWCH

SEQ ID NO: 878294 - protein, 445 aa, Homo sapiens
DRKRWDGTKNTRNSWQFELFPLLHLSFRLCKMGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKGP

SEQ ID NO: 878295 - protein, 564 aa, Homo sapiens
DRKRWDGTKNTRNSWQFELFPLLHLSFRLCKMGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 878296 - protein, 441 aa, Homo sapiens
DRKRWDGTKNTRNSWQFELFPLLHLSFRLCKMGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAIKDTVLGKWQYF

SEQ ID NO: 878297 - protein, 403 aa, Homo sapiens
DRKRWDGTKNTRNSWQFELFPLLHLSFRLCKMGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLRGDVLSPLA

SEQ ID NO: 878298 - protein, 564 aa, Homo sapiens; identical to SEQ ID NO: 878295

SEQ ID NO: 878299 - protein, 520 aa, Homo sapiens
DRKRWDGTKNTRNSWQFELFPLLHLSFRLCKMGSRCLNPPPPAHSDTTGKDSFGNIRGAETGQGASACSVTSARVTCGAGSEPHSHRNPGISAQVGLAPSYGAARGRRRPLALQQSPQERRHVGWNSTRGLLPASLPGTASSQSASATASAALPLKVTGPLARNPTPPWTAAAALATRGQRPEKGLFPGPAPFSLGKRKRGRGRTWERRRRVSIETSTCFRPGCERLGAAAGANLSQLASSQRPLRERWVLYTIIMAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKDSGGTKCLITVLTTLRLEMP

SEQ ID NO: 878300 - protein, 107 aa, Homo sapiens
MPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 878301 - protein, 564 aa, Homo sapiens; identical to SEQ ID NO: 878295

SEQ ID NO: 878302 - protein, 564 aa, Homo sapiens; identical to SEQ ID NO: 878295

SEQ ID NO: 878303 - protein, 148 aa, Homo sapiens
IKKLSSSGLSIAVHIRKNMSSIVMDAVRCFLIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKTQET

SEQ ID NO: 878304 - protein, 107 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDHFGLHYVDNKGFPTWLKLDKKASQD

SEQ ID NO: 878305 - protein, 749 aa, Homo sapiens
IKKLSSSGLSIAVHIRKNMSSIVMDAVRCFLIAQDLEMYGINYFEIKNKKGTDLWLGVDALGLNIYEKDDKIVFPWSEIRNISFNDKKFVIKPIDKKAPDFVLYAPRLRINKRILQLCMGNHELYMRRRNLTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878306 - protein, 637 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878307 - protein, 586 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878308 - protein, 606 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLGTGRAIMGRKGLDQRCLMLQTLSSELSQARDENKRTHNDIIHNENMRQGRDKYKTLRQIRQGNTKQRIDEFEAL

SEQ ID NO: 878309 - protein, 641 aa, Homo sapiens
MPKPINVRVTTMDAELEFAIQPNTTGKQLFDQETGFRHVCQASLELLNSSDPPVLASQSAGITSVSHHAQLAAFPHPFWVSGKREEEVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878310 - protein, 554 aa, Homo sapiens
MPKPINVRVTTMDAELEFAIQPNTTGKQLFDQVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878311 - protein, 637 aa, Homo sapiens; identical to SEQ ID NO: 878306

SEQ ID NO: 878312 - protein, 637 aa, Homo sapiens; identical to SEQ ID NO: 878306

SEQ ID NO: 878313 - protein, 515 aa, Homo sapiens
MSQGGVLPPWFCEIVSVGFVPILCMSGRIQLRTIVCNDGPQLNDGPQLNDGPQLNDGPQLNDGPQLNDGPQLNVVLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878314 - protein, 378 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQRRTSVCSGSC

SEQ ID NO: 878315 - protein, 399 aa, Homo sapiens [sequence omitted]

SEQ ID NO: 878316 - protein, 557 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPRRACRPLRVATPPKLVWVRCGRGPSR

SEQ ID NO: 878317 - protein, 513 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRPRRYCEQETVYRPA

SEQ ID NO: 878318 - protein, 399 aa, Homo sapiens
DIFTYAKVLALITVSVAGIVILGKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878319 - protein, 339 aa, Homo sapiens
MTKSLSLNPSTRRHLTLCDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878320 - protein, 302 aa, Homo sapiens [sequence omitted]

SEQ ID NO: 878321 - protein, 278 aa, Homo sapiens
MGEMNGKNWAKLCKDCKVADGKPVTGTDVDIVFSKVKGKSARVINYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878322 - protein, 120 aa, Homo sapiens
MTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878323 - protein, 169 aa, Homo sapiens
PESLEKSPAKLPLLKEARRRKKYNLKMASSGAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878324 - protein, 80 aa, Homo sapiens
LLGARAASALGGRKGGGEHTEHCRRRVGTASSLLLDSRVFGDRGYSPETENAETNQCPSYHHGCRAGVCNPAKYNWKTAF

SEQ ID NO: 878325 - protein, 293 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLNPNFSSDP

SEQ ID NO: 878326 - protein, 287 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGVVNVITMKNKTEDWSPGRWEEAW

SEQ ID NO: 878327 - protein, 182 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQGLFQGNRTLGFLQAKYTRTTSNLRIDI

SEQ ID NO: 878328 - protein, 194 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKCAHAEYPDTR

SEQ ID NO: 878329 - protein, 122 aa, Homo sapiens
MTKSLSLNPSTRRHLTLCDFVFYAPRLRINKRILQLCMGNHELYMRRRKPDTIEVQQMKAQAREEKHQKQLERQQLETEKKRRETDEEPGDLSKPGDLSKPGDLSKPGDLSQPGDLCMPGDL

SEQ ID NO: 878330 - protein, 78 aa, Homo sapiens
EPTGYSAELSSEGIRDDRNEEKRITEAEKNERVQRQLLVRPKGLCLQGACLAFGADRLGEGSDVSQPHPAPLLPFLFS

SEQ ID NO: 878331 - protein, 637 aa, Homo sapiens; identical to SEQ ID NO: 878306

SEQ ID NO: 878332 - protein, 586 aa, Homo sapiens; identical to SEQ ID NO: 878307

SEQ ID NO: 878333 - protein, 637 aa, Homo sapiens; identical to SEQ ID NO: 878306

SEQ ID NO: 878334 - protein, 637 aa, Homo sapiens; identical to SEQ ID NO: 878306

SEQ ID NO: 878335 - protein, 585 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPTLSSELSQARDENKRTHNDIIHNENMRQGRDKYKTLRQIRQGNTKQRIDEFEAL

SEQ ID NO: 878336 - protein, 602 aa, Homo sapiens
MCSLRTIENAAERITVSLRVPHSGCEIWRSVTRVSIYKVVHNDGMLSTVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878337 - protein, 544 aa, Homo sapiens
MCWGQWAFVFRICVESVACFVQVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878338 - protein, 637 aa, Homo sapiens; identical to SEQ ID NO: 878306

SEQ ID NO: 878339 - protein, 637 aa, Homo sapiens; identical to SEQ ID NO: 878306

SEQ ID NO: 878340 - protein, 412 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQLPNRNILGWEPGRRPGLFSPVVIVPSRPDSRDYSRITSCVVLGAGLIELRKMPVKSE

SEQ ID NO: 878341 - protein, 472 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRCGYASECGGHTLLQSNPEHLHLIN

SEQ ID NO: 878342 - protein, 393 aa, Homo sapiens
MAQVLTIPLCTSLLHLPTHVNRPLAGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878343 - protein, 424 aa, Homo sapiens
IKKLSSSGLSIAVHIRKNMSSIVMDAVRCFLIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878344 - protein, 484 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEKHQKQQEQQQLETEKKRRATVEREKEQMMREKEELTTHQTYEESKPSE

SEQ ID NO: 878345 - protein, 193 aa, Homo sapiens
MAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 878346 - protein, 391 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVHCFLLHS

SEQ ID NO: 878347 - protein, 126 aa, Homo sapiens
MAALRAKEELERQAVDQIKSQEQLAAELAEYTAKIALLEEARRRKEDEVEEWQHRAKEAQDDLVKTKEELHLVMTAPPPPPPPVYEPRATPSSASTSSRPCNSQARTKGRGVLIAGAASPATLVCL

SEQ ID NO: 878348 - protein, 293 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLAICKWQGQGQKMNHVTK

SEQ ID NO: 878349 - protein, 282 aa, Homo sapiens
GFWEPGQRAHSADARAAGSTRSTAGAGLGQRLRCCWIVVFSGIEDTHQKPKMPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGSHRLRKKSRKAQTYRMQQEPHMHIRDETI

SEQ ID NO: 878350 - protein, 99 aa, Homo sapiens
MTKSLSLNPSTRRHLTLCDFVFYAPRLRINKRILQLCMGNHELYMRRRKPDTIEVQQMKAQAREEKHQKQLERQQLETEKKRRETVEGEGEPVSNKYTK

SEQ ID NO: 878351 - protein, 174 aa, Homo sapiens
IKKLSSSGLSIAVHIRKNMSSIVMDAVRCFLIAQDLEMYGINYFEIKNKKGTDLWLGVDALGLNIYEKDDKIVFPWSEIRNISFNDKKFVIKPIDKKAPDFVLYAPRLRINKRILQLCMGNHELYMRRRNLTRSTAGAGLGQRLRCCWIVVFSGIEDTHQKPKMPKPINVRVTT

SEQ ID NO: 878352 - protein, 319 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878353 - protein, 319 aa, Homo sapiens; identical to SEQ ID NO: 878352

SEQ ID NO: 878354 - protein, 319 aa, Homo sapiens; identical to SEQ ID NO: 878352

SEQ ID NO: 878355 - protein, 319 aa, Homo sapiens; identical to SEQ ID NO: 878352

SEQ ID NO: 878356 - protein, 319 aa, Homo sapiens; identical to SEQ ID NO: 878352

SEQ ID NO: 878357 - protein, 319 aa, Homo sapiens; identical to SEQ ID NO: 878352

SEQ ID NO: 878358 - protein, 373 aa, Homo sapiens
MGLSGSDNSCDPTPPPGPLAMALFGALFLALLAGAHAEFPGCKIRVTSKALELGKAQGQTGTDGSGRGWGRPNSGQRELSKGFSAASVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878359 - protein, 319 aa, Homo sapiens; identical to SEQ ID NO: 878352

SEQ ID NO: 878360 - protein, 231 aa, Homo sapiens
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878361 - protein, 229 aa, Homo sapiens
MWPSLSSSSTLPWRATFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 878362 - protein, 267 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878363 - protein, 229 aa, Homo sapiens; identical to SEQ ID NO: 878361

SEQ ID NO: 878364 - protein, 258 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSSTAPTPSTAAV

SEQ ID NO: 878365 - protein, 319 aa, Homo sapiens; identical to SEQ ID NO: 878352

SEQ ID NO: 878366 - protein, 258 aa, Homo sapiens; identical to SEQ ID NO: 878364

SEQ ID NO: 878367 - protein, 275 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTISVTASVHAWSHRQLRSAVQLICAVSARRSGEAGRVLASIFTLGVRST

SEQ ID NO: 878368 - protein, 169 aa, Homo sapiens
MGLSGSDNSCDPTPPPGPLAMALFGALFLALLAGAHAEFPGCKIRVTSKALELVKQEGLRFLEQELETITIPDLRGKEGHFYYNISEVKVTELQLTSSELDFQPQQELMLQITNASLGLRFRRTGLLMSGRPLPPHRPQQLSEPSIPKLAAVIQDPNPSQPLFSHIHSL

SEQ ID NO: 878369 - protein, 72 aa, Homo sapiens
INPPGSYDGGYINASAEGVSIRTGLELSRDPAGRMKVSNVSCQASVSRMHAAFGGTFKYSPSPNPSSPFSSP

SEQ ID NO: 878370 - protein, 319 aa, Homo sapiens; identical to SEQ ID NO: 878352

SEQ ID NO: 878371 - protein, 319 aa, Homo sapiens; identical to SEQ ID NO: 878352

SEQ ID NO: 878372 - protein, 319 aa, Homo sapiens; identical to SEQ ID NO: 878352

SEQ ID NO: 878373 - protein, 319 aa, Homo sapiens; identical to SEQ ID NO: 878352

SEQ ID NO: 878374 - protein, 319 aa, Homo sapiens; identical to SEQ ID NO: 878352

SEQ ID NO: 878375 - protein, 339 aa, Homo sapiens
MGLSGSDNSCDPTPPPGPLAMALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878376 - protein, 293 aa, Homo sapiens
KGQASHHRRDQADGRGLENVEGAKKEAGPVDVRRGRRTTERVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFPGGGPAAVAGGGQGAPRPGHAAEGHLLWEHCPAEPSSD

SEQ ID NO: 878377 - protein, 267 aa, Homo sapiens; identical to SEQ ID NO: 878362

SEQ ID NO: 878378 - protein, 229 aa, Homo sapiens; identical to SEQ ID NO: 878361

SEQ ID NO: 878379 - protein, 319 aa, Homo sapiens; identical to SEQ ID NO: 878352

SEQ ID NO: 878380 - protein, 319 aa, Homo sapiens; identical to SEQ ID NO: 878352

SEQ ID NO: 878381 - protein, 105 aa, Homo sapiens
MALFGALFLALLAGAHAEFPGCKIRVTSKALELVKQEGLRFLEQELETITIPDLRGKEGHFYYNISDPLPPHRPQQLSEPSIPKLAAVIQDPNPSQPLFSHIHSL

SEQ ID NO: 878382 - protein, 69 aa, Homo sapiens
RARLPKGIQQRRGQATPFRNCCGNKVLTCPQAVYGRPWAQSGMYRALGRGQSWRQNPACRGTLLRRGLS

SEQ ID NO: 878383 - protein, 125 aa, Homo sapiens
MGLSGSDNSCDPTPPPGPLAMALFGALFLALLAGAHAEFPGCKIRVTSKALELVKQEGLRFLEQELETITIPDLRGKEGHFYYNISDPLPPHRPQQLSEPSIPKLAAVIQDPNPSQPLFSHIHSL

SEQ ID NO: 878384 - protein, 607 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878385 - protein, 646 aa, Homo sapiens
MPVIPATREAEAGELLEPGRQRLQPAEMAPSHSSLLFPVMEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878386 - protein, 607 aa, Homo sapiens; identical to SEQ ID NO: 878384

SEQ ID NO: 878387 - protein, 607 aa, Homo sapiens; identical to SEQ ID NO: 878384

SEQ ID NO: 878388 - protein, 472 aa, Homo sapiens
AGRGWVESNQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878389 - protein, 456 aa, Homo sapiens
SSVPLLGLCSFGVFAPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878390 - protein, 378 aa, Homo sapiens
MTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878391 - protein, 241 aa, Homo sapiens
EDPQLTAFGGRSKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878392 - protein, 406 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEIRKRQELVTKIDHILDAL

SEQ ID NO: 878393 - protein, 380 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPRSTTSWMPCSPCPHPPGGPGCLHFAVAGRLGGSGRLCMEASES

SEQ ID NO: 878394 - protein, 267 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQ

SEQ ID NO: 878395 - protein, 214 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTF

SEQ ID NO: 878396 - protein, 225 aa, Homo sapiens
GKANFYFLNLSKIHCFKEQNEQNYWTGRMVGESRDLGKGRSCKNEVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQ

SEQ ID NO: 878397 - protein, 80 aa, Homo sapiens
HERVFLELASHQALSLHRQDRPHPGCPVAPARILQGAQGACTLLWQADWVVVGGCAWRPVKADICKRPSRKRNQALRQAV

SEQ ID NO: 878398 - protein, 607 aa, Homo sapiens; identical to SEQ ID NO: 878384

SEQ ID NO: 878399 - protein, 534 aa, Homo sapiens
MQSWGDVGLASWDWVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878400 - protein, 607 aa, Homo sapiens; identical to SEQ ID NO: 878384

SEQ ID NO: 878401 - protein, 378 aa, Homo sapiens; identical to SEQ ID NO: 878390

SEQ ID NO: 878402 - protein, 415 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878403 - protein, 191 aa, Homo sapiens
TRPHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 878404 - protein, 296 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPNCCPDSRIYCN

SEQ ID NO: 878405 - protein, 80 aa, Homo sapiens; identical to SEQ ID NO: 878397

SEQ ID NO: 878406 - protein, 214 aa, Homo sapiens; identical to SEQ ID NO: 878395

SEQ ID NO: 878407 - protein, 124 aa, Homo sapiens
LDSQRCRRATGLNRLIIGFISKQYVTSLLLNEPDGTFLLRFSDSEIGGITIAHVIRGQDGSPQIENIQPFSAKREATAQQDLLVELRPGHRTVLEGLHTEAVVIEDLLGQEEEVLWEQPPVGPH

SEQ ID NO: 878408 - protein, 102 aa, Homo sapiens
MDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDR

SEQ ID NO: 878409 - protein, 847 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878410 - protein, 847 aa, Homo sapiens; identical to SEQ ID NO: 878409

SEQ ID NO: 878411 - protein, 847 aa, Homo sapiens; identical to SEQ ID NO: 878409

SEQ ID NO: 878412 - protein, 847 aa, Homo sapiens; identical to SEQ ID NO: 878409

SEQ ID NO: 878413 - protein, 847 aa, Homo sapiens; identical to SEQ ID NO: 878409

SEQ ID NO: 878414 - protein, 667 aa, Homo sapiens [sequence omitted]

SEQ ID NO: 878415 - protein, 956 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGEATPASPLSLCLCPLGFLLGMKCPDLPDADPDLQEVLPASLLPSVVYNVHLLTVSSVGTETSGSLSLRSPTLGPLSLALVEENRSYGEGLGKGKKVRTEGSQGLLPTIGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878416 - protein, 474 aa, Homo sapiens
PIPWNMLPSMAGTSTRMPALYAAPIGLPSGTALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878417 - protein, 420 aa, Homo sapiens
FGHSEQDLDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878418 - protein, 518 aa, Homo sapiens
MEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGEATPASPLSLCLCPLGFLLGMKCPDLPDADPDLQEVLPASLLPSVV

SEQ ID NO: 878419 - protein, 847 aa, Homo sapiens; identical to SEQ ID NO: 878409

SEQ ID NO: 878420 - protein, 847 aa, Homo sapiens; identical to SEQ ID NO: 878409

SEQ ID NO: 878421 - protein, 427 aa, Homo sapiens
VIYEDPRTCRGFEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKRELELAALIPSCHPLPPCSPLPSSPCPCVILMSLPYFIAVLLLLPHDPCPPFPPPFLPNPRALHGCLFLLTTAEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878422 - protein, 206 aa, Homo sapiens
KQAGTGLGFMEDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878423 - protein, 423 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878424 - protein, 812 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTCQIPVSQVEASDTCMRLCKSTRAEILRV

SEQ ID NO: 878425 - protein, 725 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQELLIRV

SEQ ID NO: 878426 - protein, 732 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEVSEKPHGDTIPL

SEQ ID NO: 878427 - protein, 667 aa, Homo sapiens [sequence omitted]

SEQ ID NO: 878428 - protein, 358 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAETLKIFLLWCSMKDSLVSGGRERG

SEQ ID NO: 878429 - protein, 229 aa, Homo sapiens [sequence omitted]

SEQ ID NO: 878430 - protein, 847 aa, Homo sapiens; identical to SEQ ID NO: 878409

SEQ ID NO: 878431 - protein, 847 aa, Homo sapiens; identical to SEQ ID NO: 878409

SEQ ID NO: 878432 - protein, 847 aa, Homo sapiens; identical to SEQ ID NO: 878409

SEQ ID NO: 878433 - protein, 847 aa, Homo sapiens; identical to SEQ ID NO: 878409

SEQ ID NO: 878434 - protein, 847 aa, Homo sapiens; identical to SEQ ID NO: 878409

SEQ ID NO: 878435 - protein, 919 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKRELELAALIPSCHPLPPCSPLPSSPCPCVILMSLPYFIAVLLLLPHDPCPPFPPPFLPNPRALHGCLFLLTTAEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878436 - protein, 847 aa, Homo sapiens; identical to SEQ ID NO: 878409

SEQ ID NO: 878437 - protein, 462 aa, Homo sapiens
TVQLAKLLYFVILQEGSHGVVLYLIGNGRIGDHFNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878438 - protein, 387 aa, Homo sapiens
RTNNNRLSRSPRLFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878439 - protein, 376 aa, Homo sapiens
WVDRGLWVDRGLWVDRGLWVDRGLWVDRGLWVDEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878440 - protein, 267 aa, Homo sapiens
MGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878441 - protein, 280 aa, Homo sapiens
PRFLLPGTESLFSFKSVVLVEPELSTKDPLPTIAPQSERSDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878442 - protein, 193 aa, Homo sapiens
AGTVRVVWMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 878443 - protein, 711 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPGIEDIGSQP

SEQ ID NO: 878444 - protein, 725 aa, Homo sapiens; identical to SEQ ID NO: 878425

SEQ ID NO: 878445 - protein, 711 aa, Homo sapiens; identical to SEQ ID NO: 878443

SEQ ID NO: 878446 - protein, 298 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLTV

SEQ ID NO: 878447 - protein, 329 aa, Homo sapiens
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878448 - protein, 329 aa, Homo sapiens; identical to SEQ ID NO: 878447

SEQ ID NO: 878449 - protein, 832 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGEWETREEEGGCPRPGGRERGAAGRGGRGRSRGPAGGGRNRRAVSGRDRSATLCGAPFPRHRGQLTPEQRTGVAAAGGAARLGRPRHGPGTPAGPCRASPFPAQRLGNPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878450 - protein, 709 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPSPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878451 - protein, 867 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGEWETREEEGGCPRPGGRERGAAGRGGRGRSRGPAGGGRNRRAVSGRDRSATLCGAPFPRHRGQLTPSRGPGSRPPGAQRGEGGPATAQALPLGPAGPHPSPRSDSGSRTSCGEPRTRETPWEEVAGMGAMGGQSGLGVTRVGCGAPGWRLSLCAPCSPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878452 - protein, 868 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGEWETREEEGGCPRPGGRERGAAGRGGRGRSRGPAGGGRNRRAVSGRDRSATLCGAPFPRHRGQLTPEQRTGVAAAGGAARLGRPRHGPGTPAGPCRASPFPAQRLGNPASAWSSSYPHAPYLGSARSLSPHKMADGGSPFLGRRDFVYPSSTRDPSASNGGGSPARREEKKVRRGPGVGDLEWSQGCHPGSATRPTERAHSVLSPAQRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878453 - protein, 329 aa, Homo sapiens; identical to SEQ ID NO: 878447

SEQ ID NO: 878454 - protein, 365 aa, Homo sapiens
MADGGSPFLGRRDFVYPSSTRDPSASNGGGSPARREEKKVRRGPGVGDLEWSQGCHPGSATRPTERAHSVLSPAQRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878455 - protein, 427 aa, Homo sapiens
PRAPASGTPAPSPSSRPAPGIGRAGASRTPRPARSPPLPSRELFRRRRPRLPLGPGVAGPDCAVSPRRARRRPDGPRSSGPRPDPSASNGGGSPARREEKKVRRGPGVGDLEWSQGCHPGSATRPTERAHSVLSPAQRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878456 - protein, 250 aa, Homo sapiens
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQTRDGILLESPS

SEQ ID NO: 878457 - protein, 684 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGEWETREEEGGCPRPGGRERGAAGRGGRGRSRGPAGGGRNRRAVSGRDRSATLCGAPFPRHRGQLTPEQRTGVAAAGGAARLGRPRHGPGTPAGPCRASPFPAQRLGNPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYASHSGRNVGGACSSWLSLFSGERPSSVSLKQ

SEQ ID NO: 878458 - protein, 718 aa, Homo sapiens
ERPRQAAAGQGCSCAPGRPRAQPPARRGRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878459 - protein, 882 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGEWETREEEGGCPRPGGRERGAAGRGGRGRSRGPAGGGRNRRAVSGRDRSATLCGAPFPRHRGQLTPSRGPGSRPPGAQRGEGGPATAQALPLGPAGPHPSPRSDSGSRTSCGEPRTRETPWEEVAGMGAMGGQSGLGVTRVGCGAPGWRLSLCAPCSPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878460 - protein, 849 aa, Homo sapiens
MARIPGVGRASASPSWEKKEESESDVVLLSPKDPDRGHAEEQLACPESSHLDPSMQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGLSGRRGRRKGAVPGRAGGNVARPGGADGGDRGAQPGEEGTAEPCPGGTAAPLSAGRRSRATEGSYLLAEDRGRGRRGRSAVRAAPPRPRHSRWALPGLTLPRAATREVGHPVESPGPGRRPGRSPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPTDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878461 - protein, 382 aa, Homo sapiens [sequence omitted]

SEQ ID NO: 878462 - protein, 382 aa, Homo sapiens [sequence omitted]

SEQ ID NO: 878463 - protein, 329 aa, Homo sapiens; identical to SEQ ID NO: 878447

SEQ ID NO: 878464 - protein, 93 aa, Homo sapiens
AHEVAVHDGWFVDKKKKYHFCIRSHKRFERNGRDLCPFRCLPEDPEIRNVPWKLRCPGVSGLHGNLEPARMGWGAVALVGGRGPPPTSSFPRT

SEQ ID NO: 878465 - protein, 109 aa, Homo sapiens
PSTPACWLPSLPTQEPRPQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 878466 - protein, 1136 aa, Homo sapiens [sequence omitted]

SEQ ID NO: 878467 - protein, 1035 aa, Homo sapiens
VTRCPQHILPMVGSTPHFGDPCAGSPGPGGRGDPDGRGDHLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878468 - protein, 1092 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRPALIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878469 - protein, 638 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLLLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878470 - protein, 595 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSTVWFFHRHVYFAEIKSF

SEQ ID NO: 878471 - protein, 234 aa, Homo sapiens
SRPVSPQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSTVWFFHRHVYFAEIKSF

SEQ ID NO: 878472 - protein, 279 aa, Homo sapiens
LVRARVCNRPRLWRTRYQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKRRSYGTTALVGERRTEQSEVPGRRGNRGPQGHQVGVPPRLRRRT

SEQ ID NO: 878473 - protein, 1140 aa, Homo sapiens
MISSIPARFALTVGGDGRFHSHERAGTPVIHARLELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878474 - protein, 1161 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLDDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGGTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRWSRHMEWRARGPGSRSAPGPCPPRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878475 - protein, 308 aa, Homo sapiens
HQHLLTLDSAQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 878476 - protein, 159 aa, Homo sapiens [sequence omitted]

SEQ ID NO: 878477 - protein, 147 aa, Homo sapiens
MWLWVWLIHTLHSGLQKPRERSLPEATFQNLLHPPTDLPSPCPLFESRCQVLPADTWLLEGRCSFHLTMQACFAVGRAVLSSSQLHTGITWRVQKLPASVKEHQCISTANIPNARLDSLQLPGPPGFSSFQELSDPGSSLNVGYKLT

SEQ ID NO: 878478 - protein, 236 aa, Homo sapiens
GGRGGGRQIYKSSEAHTFFALNRILFSTDTYTHRNELFKEDGPDSTVQKKKRFALLLKESGYECRGLPVGSHIRSSTSTLNASDASPSVNVALGMANPHPALWPSEAQGEKPPRSNLPEPSPSSHDLPSPCPLFESRCQVLPADTWLLEGRCSFHLTMQACFAVGRAVLSSSQLHTGITWRVQKLPASVKEHQCISTANIPNARLDSLQLPGPPGFSSFQELSDPGSSLNVGYKLT

SEQ ID NO: 878479 - protein, 147 aa, Homo sapiens; identical to SEQ ID NO: 878477

SEQ ID NO: 878480 - protein, 385 aa, Homo sapiens
MKLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYMFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 878481 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 878482 - protein, 839 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEEIKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 878483 - protein, 385 aa, Homo sapiens; identical to SEQ ID NO: 878480

SEQ ID NO: 878484 - protein, 385 aa, Homo sapiens; identical to SEQ ID NO: 878480

SEQ ID NO: 878485 - protein, 189 aa, Homo sapiens
RAGPAGWAQLKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 878486 - protein, 1037 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLMQTADPISLRILSVSTLERK

SEQ ID NO: 878487 - protein, 1155 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDILILGPKPGWPQIEDVNQDQALALAIKEAKLQHPDMLVTKAVVYRETDPSPEERDKKPQEILTSVKNPDILIWPSLW

SEQ ID NO: 878488 - protein, 102 aa, Homo sapiens [sequence omitted]

SEQ ID NO: 878489 - protein, 1030 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSEMQTW

SEQ ID NO: 878490 - protein, 1179 aa, Homo sapiens; identical to SEQ ID NO: 878481

SEQ ID NO: 878491 - protein, 1179 aa, Homo sapiens; identical to SEQ ID NO: 878481

SEQ ID NO: 878492 - protein, 980 aa, Homo sapiens
MDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 878493 - protein, 1192 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKREIMGHPAECFCRIVAVNAAHFSTVEDWILQKTTEKENGEMKYFTKENNNNYSIIYPQVCLKYVTRNV

SEQ ID NO: 878494 - protein, 1037 aa, Homo sapiens; identical to SEQ ID NO: 878486

SEQ ID NO: 878495 - protein, 184 aa, Homo sapiens
RFPLSWALDYNVLTWQNLRHGTYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 878496 - protein, 189 aa, Homo sapiens
GRSNIKVYVALDSPGFVREQFCDYMFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 878497 - protein, 273 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARWKANYPCSHFICLLR

SEQ ID NO: 878498 - protein, 140 aa, Homo sapiens
MRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 878499 - protein, 236 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 878500 - protein, 123 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQHSCWTSMTR

SEQ ID NO: 878501 - protein, 140 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 878502 - protein, 140 aa, Homo sapiens; identical to SEQ ID NO: 878501

SEQ ID NO: 878503 - protein, 140 aa, Homo sapiens; identical to SEQ ID NO: 878501

SEQ ID NO: 878504 - protein, 140 aa, Homo sapiens; identical to SEQ ID NO: 878501

SEQ ID NO: 878505 - protein, 140 aa, Homo sapiens; identical to SEQ ID NO: 878501

SEQ ID NO: 878506 - protein, 140 aa, Homo sapiens; identical to SEQ ID NO: 878501

SEQ ID NO: 878507 - protein, 126 aa, Homo sapiens
MDVFMKGLSKAKEGVVAAAEKTKQGVAEAAGKTKEGVLYVVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 878508 - protein, 115 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKVWLCTFCVTFISW

SEQ ID NO: 878509 - protein, 140 aa, Homo sapiens; identical to SEQ ID NO: 878501

SEQ ID NO: 878510 - protein, 140 aa, Homo sapiens; identical to SEQ ID NO: 878501

SEQ ID NO: 878511 - protein, 140 aa, Homo sapiens; identical to SEQ ID NO: 878501

SEQ ID NO: 878512 - protein, 112 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKEGYQDYEPEA

SEQ ID NO: 878513 - protein, 140 aa, Homo sapiens; identical to SEQ ID NO: 878501

SEQ ID NO: 878514 - protein, 106 aa, Homo sapiens
MEGWGDPGQTCSLAMRMEIREPTVTTPSGLNVGLQALLFSPRPLLHSYPHPLRWQIHLLRGQICLKIDVGTVSKTCHSDTTCMWIFFFLDRISLLSPRLEYSGTVM

SEQ ID NO: 878515 - protein, 120 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEVTICVNTLQVI

SEQ ID NO: 878516 - protein, 213 aa, Homo sapiens
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRGK

SEQ ID NO: 878517 - protein, 102 aa, Homo sapiens
WIGLGSQFPSGQTLPLCPEDLLVWGKRPLEAPGSCQVLDMVNWEVLPSGHSAEVSPCWGMGNRAVNGPICISSMCLERKTSQSRRVRVPRSALATPTSSLKE

SEQ ID NO: 878518 - protein, 253 aa, Homo sapiens
MLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 878519 - protein, 526 aa, Homo sapiens
LRSRCHLLRPWERCGCCFLRLSSSCSTMWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPPASASSSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 878520 - protein, 520 aa, Homo sapiens
LRSRCHLLRPWERCGCCFLRLSSSCSTMWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 878521 - protein, 484 aa, Homo sapiens
LRSRCHLLRPWERCGCCFLRLSSSCSTMWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEV

SEQ ID NO: 878522 - protein, 520 aa, Homo sapiens; identical to SEQ ID NO: 878520

SEQ ID NO: 878523 - protein, 643 aa, Homo sapiens
LRSRCHLLRPWERCGCCFLRLSSSCSTMWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRSVWMVWWREELGLLRDGPQAKQGSGTHSHRLEGSMRTLVGLLTSNQALLQLEAARCLHELSHSEQSTVAEACLPATSYLLTYLSSHSSDFIVSPVPSYLVLGLDFKIVLLGPFELAGRRKKTCLPLCLQPWLHPSSPHPLVSRKDSCSSVPITSSSPSPHTQPGMKQAKPSAFVACSQELCLYTLGNLIVESEAVRRQLLPQGIVPALAACIQSPHVAVLEALGYALSQLLQAEEAPEKIIPPASASSSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 878524 - protein, 253 aa, Homo sapiens; identical to SEQ ID NO: 878518

SEQ ID NO: 878525 - protein, 323 aa, Homo sapiens
LRSRCHLLRPWERCGCCFLRLSSSCSTMWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILGSISTQDMLEMLKAGPKVCKQVSNLCHCMGSVYSGVVCELVGVRKRDETEWDAVLMLRTVLRE

SEQ ID NO: 878526 - protein, 520 aa, Homo sapiens; identical to SEQ ID NO: 878520

SEQ ID NO: 878527 - protein, 520 aa, Homo sapiens; identical to SEQ ID NO: 878520

SEQ ID NO: 878528 - protein, 253 aa, Homo sapiens; identical to SEQ ID NO: 878518

SEQ ID NO: 878529 - protein, 250 aa, Homo sapiens
AGTVGQFGMKCLPPNLDLLKYNRSYTVENAYECSECGKAFKKKFHFIRHEKNHTRKKPFECNDCGKAYSRKAHLATHQKIHNGERPFVCNDCGKAFMHKAQLVVHQRLHTGEKPYECSQCGKTFTWNSSFNQHVKSHTLEKSFECKECGKTFRYSSSLYKHSRFHTGEKPYQCIICGKAFGNTSVLVTHQRIHTGEKPYSCIECGKAFIKKSHLLRHQITHTGEKPYECNRCGKAFSQKSNLIVHQKIHT

SEQ ID NO: 878530 - protein, 378 aa, Homo sapiens
MISFQESVTFQDVAVDFTAEEWQLLDCAERTLYWDVMLENYRNLISVGCPITKTKVILKVEQGQEPWMVEGANPHESSPESDYPLVDEPGKHRESKDNFLKSVLLTFNKILTMERIHHYNMSTSLNPMRKKSYKSFEKCLPPNLDLLKYNRSYTVENAYECSECGKAFKKKFHFIRHEKNHTRKKPFECNDCGKAYSRKAHLATHQKIHNGERPFVCNDCGKAFMHKAQLVVHQRLHTGEKPYECSQCGKTFTWNSSFNQHVKSHTLEKSFECKECGKTFRYSSSLYKHSRFHTGEKPYQCIICGKAFGNTSVLVTHQRIHTGEKPYSCIECGKAFIKKSHLLRHQITHTGEKPYECNRCGKAFSQKSNLIVHQKIHT

SEQ ID NO: 878531 - protein, 342 aa, Homo sapiens [sequence omitted]

SEQ ID NO: 878532 - protein, 223 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 878533 - protein, 223 aa, Homo sapiens; identical to SEQ ID NO: 878532

SEQ ID NO: 878534 - protein, 114 aa, Homo sapiens [sequence omitted]

SEQ ID NO: 878535 - protein, 223 aa, Homo sapiens; identical to SEQ ID NO: 878532

SEQ ID NO: 878536 - protein, 223 aa, Homo sapiens; identical to SEQ ID NO: 878532

SEQ ID NO: 878537 - protein, 181 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFRRDLRPQVLS

SEQ ID NO: 878538 - protein, 387 aa, Homo sapiens
MRVGRHVYISQRQRASAILFMSWQESLSVTCRLWMWMTGHLCTGLQLQEKAECVQSLLELGMDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 878539 - protein, 295 aa, Homo sapiens
MLRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 878540 - protein, 295 aa, Homo sapiens; identical to SEQ ID NO: 878539

SEQ ID NO: 878541 - protein, 295 aa, Homo sapiens; identical to SEQ ID NO: 878539

SEQ ID NO: 878542 - protein, 426 aa, Homo sapiens
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCRLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 878543 - protein, 537 aa, Homo sapiens
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCRLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 878544 - protein, 89 aa, Homo sapiens
NAGIRYRAHYQQHKKLLAAMLSQDSFESIHSPTPSVTEEDIDNEDDAMELLGFKETTWKKGQKSHYQYSILQMKKSQIHSIPCLGLKKH

SEQ ID NO: 878545 - protein, 406 aa, Homo sapiens
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLGFKETTWKKGQKSHYQYSILQMKKSQIHSIPCLGLKKH

SEQ ID NO: 878546 - protein, 146 aa, Homo sapiens
EGWCALSTLLPRSVSLAGLPGREPAKSPRPCTGKAPNTQLLILCLRRSYITTLRSQRGALSSYEWKLPASHQSVSKPARARGPPRPSHHGAGSPCPLGLSQTPPSPSSAVLSVEVPDIGSFSLHPSQHCCGKHSPFACTSPDQCLF

SEQ ID NO: 878547 - protein, 92 aa, Homo sapiens
SEPRNIVLETYVRDRHLDPRSSVLESHVRVKHSDPRSSVLEFYVSDKHSDSSSSDVAYPWILEKKVDGSKCPIQQQLERKIKNFVLYLKHFS

SEQ ID NO: 878548 - protein, 75 aa, Homo sapiens
MVVLGMQTEEGHCIMLRGLAPSLGGTQVICKVVGLPSSIGFNTSSHLLFPATLQGAPTHFPCRWRQGGSTDNPPA

SEQ ID NO: 878549 - protein, 156 aa, Homo sapiens
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTP

SEQ ID NO: 878550 - protein, 164 aa, Homo sapiens
PSGPSLHSEMLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTP

SEQ ID NO: 878551 - protein, 216 aa, Homo sapiens
RPHWPSRGPRGAAAWPAPQAAQGPASAAPCGRYPLRASAAPAGPGCPCCPVQAGPGAPSPLGTQAARPPARRHHLLCPRRPCTGKWGAWTSSQAAASPASELPHHTFFRTANSPSSAGLRAPVSWPGAWWGHRESCTSPVRTNSEPNAKPQPAATRTQATLPGQQTHSLLSPGSFPIPSKTSFCETSAMAAGETVSPPFHKTTPSSMRPISGCARM

SEQ ID NO: 878552 - protein, 291 aa, Homo sapiens
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKE

SEQ ID NO: 878553 - protein, 431 aa, Homo sapiens
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDERQDLTLSPRLECGGVIMAYCSLKLLGSSDPPTSAS

SEQ ID NO: 878554 - protein, 401 aa, Homo sapiens
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDERQDLTLSPRLECGGVIMAYCSLKLLGSSDPPTSAS

SEQ ID NO: 878555 - protein, 85 aa, Homo sapiens
MKIDQNNPLGMCPGPPRGKSFPSIQRCRIHRGRRALATREEPHERTRCPHKWERSWAQSVLTQPPSVSGAPGQRVTISCTGSSSN

SEQ ID NO: 878556 - protein, 103 aa, Homo sapiens
MPGPRAAREEVQRQRRHVEGEDETNCETPSPGLSGRSPVPAPSSAHHRKNGLTQGHTALNASCFAVSRRIKDTLGWAQCLKPVIPALQEAEAGGSLELRSWRQ

SEQ ID NO: 878557 - protein, 353 aa, Homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 878558 - protein, 206 aa, Homo sapiens [sequence omitted]

SEQ ID NO: 878559 - protein, 155 aa, Homo sapiens [sequence omitted]

SEQ ID NO: 878560 - protein, 318 aa, Homo sapiens
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 878561 - protein, 318 aa, Homo sapiens; identical to SEQ ID NO: 878560

SEQ ID NO: 878562 - protein, 318 aa, Homo sapiens; identical to SEQ ID NO: 878560

SEQ ID NO: 878563 - protein, 671 aa, Homo sapiens
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDKPQQITHKNDPKNEEEEKRRIEAGERNQRRKEEKKTSEKYGDGYRMAFTMFIFRTLSEHLKKKILNLHLESSSHQETLDHIQKQTKFDKVVHGVFGMSVLGELDARNNILFRKGKDKLFHQKVVKHKLTTMGWTCSVDVTCGGSAVMRLAVLILLLLVRAKLWTSRNRLEIRRVGYLIQGKLREL

SEQ ID NO: 878564 - protein, 532 aa, Homo sapiens
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGE

SEQ ID NO: 878565 - protein, 736 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGGEWEQALGGGPPPGSQACASSPLPSPSVFSGSGRQGPAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 878566 - protein, 726 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGGEWEQALGGGPPPGSQACASSPLPSPSVFSGSGRQGPRGSAPLLSHDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 878567 - protein, 567 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIGPTAFLGEVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGGEWEQALERRAAPGEPGLCQLTSSLPICFLRQRPPGAARLCSSYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 878568 - protein, 756 aa, Homo sapiens
MPVPWFLLSLALGRSPVVLSLERLVGPQDATHCSPGLSCRLWGATKFWAWNSFSSHPLLHYTDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGGEWEQALGGGPPPGSQACASSPLPSPSVFSGSGRQGPAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 878569 - protein, 415 aa, Homo sapiens
EGCLTSQDCASSQKDHEEREEGRAVHGAAPQDLSRNLEFSELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 878570 - protein, 415 aa, Homo sapiens; identical to SEQ ID NO: 878569

SEQ ID NO: 878571 - protein, 427 aa, Homo sapiens
MQGLLTSGRKPSGGGRCTGRGGWRGQWCLKPWMGGADPPTPTLSCLLLPVPPELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 878572 - protein, 367 aa, Homo sapiens
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 878573 - protein, 110 aa, Homo sapiens
NLALQLLCLMRMASRQPCPGPALTSGEDRQLTGQDTDFGGNCPSTHIASCRGQGHAEPGKPGKMHKQAQPNFAFCRFQVGRGKQISEERVVGEEHWTEGRRPKTNSSHCL

SEQ ID NO: 878574 - protein, 43 aa, Homo sapiens
MGSDKALAGPKFMSTSSLQAVVALITQGKGVTAGEVHRLLLRG

SEQ ID NO: 878575 - protein, 322 aa, Homo sapiens
HSCAPSPPVAHPTLCSIPTCAPTCGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 878576 - protein, 129 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYVSGHV

SEQ ID NO: 878577 - protein, 323 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 878578 - protein, 113 aa, Homo sapiens
AFVGCSKSSVSSPGAPSPSIWEAKAASRSENRQNLCYSVTGRHREIRSSDARTSRKLGNDIFSHDTQGLLRKKLIEASFQKVILDGYGSCGPQNLNLRKEWESEGLLYRKGLG

SEQ ID NO: 878579 - protein, 139 aa, Homo sapiens
MEQVSFTERGLDKEERPSEEKIRHSLLIPVRATCKARIRVQLRWGNSRKREIHSMDSCQDRAGQHQGHEPKVQKDCLTLEKKPKASDTVHISEMRRPMMPAVGDPQRPTPGTASGQISVSRRPPTTTSEKPGDLSAHSI

SEQ ID NO: 878580 - protein, 110 aa, Homo sapiens
AFVGCSKSSVSSPGAPSPSIWEAKAASRSENRQNLCYSVTGRHREIRSSDARTSRKLGNDIFSHDTQGLLRKKLIEASFQKVILDGYGSCGPQNLNLRKEWESEGKIILW

SEQ ID NO: 878581 - protein, 126 aa, Homo sapiens
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEGKIILW

SEQ ID NO: 878582 - protein, 171 aa, Homo sapiens
MANQQLVAWACDGSPDGLQSVWTTQALAEGIAGWHVTLRGTGSCVQVICRLVKKVEIQAQAGVLQSTWAAQGLCVLAQESCRKVTARPRMQSRKGTVLSPCLGQIPMDILTCTLLIPSPRQKKGRKPLPTTLPLQCLLLRKHSTALTLKGQYLKECHCITQGIFIEWRIQS

SEQ ID NO: 878583 - protein, 171 aa, Homo sapiens; identical to SEQ ID NO: 878582

SEQ ID NO: 878584 - protein, 68 aa, Homo sapiens
RGPQSHILGTQEEEEPQKLASQKPEEKSFKEDGVVLQRSHRGYRLGSAGIGCEHLTMRGASQCQVAVD

SEQ ID NO: 878585 - protein, 131 aa, Homo sapiens
EQRAHTVEGTHSGGQTQWRAHTVEGTHSGGHTQWRAHTAEGTHSGVTSDPHALRGCHLPARVWIITVICIFTPQRECTYTSVLLHLALIGMSGIWGNEKAETAIKNVALRPGAVAHACNPSTLGGRGGQIT

SEQ ID NO: 878586 - protein, 104 aa, Homo sapiens
EDGSRESTCNRPGPSTGGTDAVLLPAFPRATLGSTPVGPLDALGARQLLGNAGSPQERSSTGDVGWRIRMGRTPKLAPNSAHPLLYRALGSGLLVRPAASWEER

SEQ ID NO: 878587 - protein, 86 aa, Homo sapiens
RSRRGDSRQRKLLGVKKTKNATPPAWCVLEMRKWRYQKVGSELQSLAPEPLYLTTGIHRYSHSRVSHRAALYGLLEKSCLSPPSRL

SEQ ID NO: 878588 - protein, 156 aa, Homo sapiens
ENINKKRNATALPIEQPSFFFFTSLTNLLSKKKKRRRRRNQGREGGKCLTKFPQIKQCPIYGTVAHGHSSCAVLPLQHIPCYAHSATHSNTYLSNTQDLITQPGDGNINRTGPNTQKAQPRNHTESYDKNVFMVYGVSSLDATRVKKMEKLVKLRQ

SEQ ID NO: 878589 - protein, 193 aa, Homo sapiens
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANR

SEQ ID NO: 878590 - protein, 101 aa, Homo sapiens
MRWWMNPQDTCGCAAMCSYFTKDLWPEQDIKDSFQQVILRRYGKCEHENLQLRKGSASVDEYKVHKEGYNELNQCLTTTQSKIFPCDKYVKVFHKFLNANR

SEQ ID NO: 878591 - protein, 459 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 878592 - protein, 410 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPEPPSPDSPTETFAAPAEVRHFTDGSFPAGFVLQLFSHTQLRGPDSKDSPKDREVAEGGLPRAESPSPGSPHFKSWGTLCANSIYLECSPSGAPRDTGSPGYPRADGGAPSGQPPARLVQAPPGHQACGSR

SEQ ID NO: 878593 - protein, 459 aa, Homo sapiens; identical to SEQ ID NO: 878591

SEQ ID NO: 878594 - protein, 415 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPGSPHFKSWGTLCANSIYLEWYIGWRQ

SEQ ID NO: 878595 - protein, 354 aa, Homo sapiens
GARIPSPPGLPDAPRSRGGPDAPVAGPAGERRAGGGERAARGGRRARRYSGQEAERRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSGDRDPEREGDRDPEREGDRDPEREGDRDPEREGDRDPEREGDRDPEREGDRDPEREGHGDRGRQRQRDAERTGPPQREDRWGGGDKETKTGMGGGPGFRAGVPAPLWSPEHAATWCPGPAHAQ

SEQ ID NO: 878596 - protein, 392 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPVSA

SEQ ID NO: 878597 - protein, 399 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPGLTPSRRSQF

SEQ ID NO: 878598 - protein, 347 aa, Homo sapiens
GPGLPPRPGSRRAEVSGRPGRAGRRPGRRAAGGRRGAGCAGRAAGPALFRPGGGRRLPAARRSLRASPPATAIAHGRTMALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPEPPSPDSPTETFAAPAEVRHFTDGSFPAGFVLQLFSHTLQRPEAGPGHPIHSRSHLHLFSCCIYHLC

SEQ ID NO: 878599 - protein, 186 aa, Homo sapiens
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHRRIPILFFANKMDLRDAVTSVKVSQLLCLENIKDKPWHICASDAIKGEGLQEGVDWLQDQIQTVKT

SEQ ID NO: 878600 - protein, 186 aa, Homo sapiens; identical to SEQ ID NO: 878599

SEQ ID NO: 878601 - protein, 186 aa, Homo sapiens; identical to SEQ ID NO: 878599

SEQ ID NO: 878602 - protein, 186 aa, Homo sapiens; identical to SEQ ID NO: 878599

SEQ ID NO: 878603 - protein, 186 aa, Homo sapiens; identical to SEQ ID NO: 878599

SEQ ID NO: 878604 - protein, 146 aa, Homo sapiens
RARRSALQQLHGGGNRPSAPSPVAAEGPWLEVSSSGRGGAGRGQGLAGSQARGTRDPEAAQAMLHHLGAQLQAPGNSQAGWRAQPRRTGARCRRGCGQARRSARRRLHRGRNRPSAPSPRTVPGAAPISLRRRGAGVTARREGMRA

SEQ ID NO: 878605 - protein, 137 aa, Homo sapiens
DLPPQGEHRREPQLGPQSSCVSVSVTVGNVLGRHKDKSTVNNETRVCYGSFCSKCFLAREKVHERAPSRGRPFSIWCCALTGSHLPQLLLPLACGPHREGPFLSSSAYPQGRGLLDKSCKPGCGPSRGSVEWGWPGQ

SEQ ID NO: 878606 - protein, 86 aa, Homo sapiens
PDVSHRARPAESFIAIVMYYVLIVCARLPWDWQCSGFVYTSITTLTRHALPLDCYSDGSFQLCCDLMDRHHMWSVVDRMYEVHDCT

SEQ ID NO: 878607 - protein, 909 aa, Homo sapiens
RACASVRLSHAGSVSLALGVSCLGLIRAVAAAAAMGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVLEALYRLQWTSTDGLGVLIISPTRELAYQTFEVLRKVGKNHDFSAGLIIGGKDLKHEAERINNINILVCTPGRLLQHMDETVSFHATDLQMLVLDEADRILDMGFADTMNAVIENLPKKRQTLLFSATQTKSVKDLARLSLKNPEYVWVHEKAKYSTPATLEQNYIVCELQQKISVLYSFLRSHLKKKSIVFFSSCKEVQYLYRVFCRLRPGVSILALHGRQQQMRRMEVYNEFVRKRAAVLFATDIAARGLDFPAVNWVLQFDCPEDANTYIHRAGRTARYKEDGEALLILLPSEKAMVQQLLQKKVPVKEIKINPEKLIDVQKKLESILAQDQDLKERAQRCFVSYVRSVYLMKDKEVFDVSKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 878608 - protein, 909 aa, Homo sapiens; identical to SEQ ID NO: 878607

SEQ ID NO: 878609 - protein, 394 aa, Homo sapiens
STLYIPVLHYKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 878610 - protein, 208 aa, Homo sapiens
MTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 878611 - protein, 335 aa, Homo sapiens
RACASVRLSHAGSVSLALGVSCLGLIRAVAAAAAMGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVLEALYRLQWTSTDGLGVLIISPTRELAYQTFEVLRKVGKNHDFSAGLIIGGKDLKHEAERINNINILVCTPGRLLQHMDETVSFHATDLQMLVLDEADRILDMGFADTMNAVIENLPKKRQTLLFSATQTKSVKDLARLSLKNPEYVWVHEKAKYRKSIKKLVLKNLNNSNLFS

SEQ ID NO: 878612 - protein, 125 aa, Homo sapiens
FGKIWIEQGLIDSKGQDLVPKELIMQVLENLQLPEEIAVVHVPQHQHQKNSSFESWGNNLADQVAKQAASSQVSPIFHLTSSLPPPAAIPIFSHADQEKLKKTGAKESPKGKWVLTDGREMLSKP

SEQ ID NO: 878613 - protein, 103 aa, Homo sapiens
MEDVNSNVNADQERVSFCRPGWSAMARSRLTATSVSQVQENGFVKKLEPKSGWMTFLEVTGKICEMLFCPEAILLTRKDTLYCETGLIFLTLTKTIANTYFYF

SEQ ID NO: 878614 - protein, 80 aa, Homo sapiens
DIGAASPNPGPALRRRFICGQRCFGTRAGGTLATGPGPAICGGLGWSERRGRLFPPALPLLLREREGRGRRRQRGRDGGR

SEQ ID NO: 878615 - protein, 396 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSRTRKRVQK

SEQ ID NO: 878616 - protein, 396 aa, Homo sapiens; identical to SEQ ID NO: 878615

SEQ ID NO: 878617 - protein, 223 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIR

SEQ ID NO: 878618 - protein, 396 aa, Homo sapiens; identical to SEQ ID NO: 878615

SEQ ID NO: 878619 - protein, 396 aa, Homo sapiens; identical to SEQ ID NO: 878615

SEQ ID NO: 878620 - protein, 396 aa, Homo sapiens; identical to SEQ ID NO: 878615

SEQ ID NO: 878621 - protein, 420 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSEESQGAIHRSMSQPEASSSSYDSSRTRKRVQK

SEQ ID NO: 878622 - protein, 405 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKVQEPERESRSNSDAVNQISFSLFSFDFFLLFYLNCFIFL

SEQ ID NO: 878623 - protein, 375 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKVGLMRDVESSSRGCLVIME

SEQ ID NO: 878624 - protein, 375 aa, Homo sapiens; identical to SEQ ID NO: 878623

SEQ ID NO: 878625 - protein, 394 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKVNFVIKLFFGLLVFIIAINTKRKYSSSSMKNNNRLHGN

SEQ ID NO: 878626 - protein, 396 aa, Homo sapiens; identical to SEQ ID NO: 878615

SEQ ID NO: 878627 - protein, 365 aa, Homo sapiens [sequence omitted]

SEQ ID NO: 878628 - protein, 266 aa, Homo sapiens [sequence omitted]

SEQ ID NO: 878629 - protein, 591 aa, Homo sapiens
SKKSPFRKSKIECPSPGELDQKEPQMSPSVAASLSCPVPSTPPELSQRATLDTVPPPPPSKVGKRCRKTSDPRRSIVECQPDASATPGVGTADSPAAPTDSRDDQKGLSLSPQSPPERRGYPGPGLRSDWHASSPLLITSDTEHVTLLSEAEHHGIGDLKSNVLSVEEGEGLRTADAEKSSLSHPGIPPSPPSCGPGSPLMPSCDVHCTTDGRQCQASAQLDNLPASAWHSTDSASPQTYEVELEMQASGLPKLRIKKIDPSSSLEAEPLSKEESSLGEESFLPALSMPRASRSLSKPEPTYVSPPCPRLSHSTPGKSRGQTYICQACTPTHGPSSTPSPFQTDGVPWTPSPKHSGKTTPDIIKDWPRRKRAVGCGAGSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSRAFSRRRPISRTYTRKKLMGTWLEDL

SEQ ID NO: 878630 - protein, 591 aa, Homo sapiens; identical to SEQ ID NO: 878629

SEQ ID NO: 878631 - protein, 170 aa, Homo sapiens
GCGAGSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGEFVFETQFPHGFFWSECLTRRHLGVASWEAWASRLG

SEQ ID NO: 878632 - protein, 107 aa, Homo sapiens
AGTTGVRHHPRLIFKFFVQMWFCYIAQAGLELLGSSNPPVSASQSAGITGVSYHVRPRSASSETMARERQTDLDLLQGGLSSSGTPIKKKECLPEPHLSVGLEAGPL

SEQ ID NO: 878633 - protein, 319 aa, Homo sapiens
ACAPNCARGIKRGEKKPEENSRPKQNARRGGRAACSPRPRPRPRRDARGPARDARAAAVPAPGRWRGGRAPASIARRGDSAPGFRRRWGPSLSMGLRDWLRTVCCCCRCECLEERALPEKEPLVSDNNPYSSFGATLVRDDEKNLWSMPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHLHLWGDLSCRLAHMQGVLH

SEQ ID NO: 878634 - protein, 141 aa, Homo sapiens
LRKRDSLINADQEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHYLPFPSP

SEQ ID NO: 878635 - protein, 95 aa, Homo sapiens
HAPQIALGELKEGKKSPKKTHAPNKTQGEEGARPAALARVPGRGVMRADQPATPGLPLSPHLDAGAVAAPQPRSLAAATRPQASGAGGGPRSPWG

SEQ ID NO: 878636 - protein, 307 aa, Homo sapiens
ACAPNCARGIKRGEKKPEENSRPKQNARRGGRAACSPRPRPRPRRDARGPARDARAAAVPAPGRWRGGRAPASIARRGDSAPGFRRRWGPSLSMGLRDWLRTVCCCCRCECLEERALPEKEPLVSDNNPYSSFGATLVRDDEKNLWSMPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHYLPFPSP

SEQ ID NO: 878637 - protein, 307 aa, Homo sapiens; identical to SEQ ID NO: 878636

SEQ ID NO: 878638 - protein, 307 aa, Homo sapiens; identical to SEQ ID NO: 878636

SEQ ID NO: 878639 - protein, 155 aa, Homo sapiens
LPPFPIYYLPREMLVCNDSLIFHRYIEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHYLPFPSP

SEQ ID NO: 878640 - protein, 112 aa, Homo sapiens [sequence omitted]

SEQ ID NO: 878641 - protein, 702 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 878642 - protein, 702 aa, Homo sapiens; identical to SEQ ID NO: 878641

SEQ ID NO: 878643 - protein, 688 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 878644 - protein, 524 aa, Homo sapiens
MLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 878645 - protein, 524 aa, Homo sapiens; identical to SEQ ID NO: 878644

SEQ ID NO: 878646 - protein, 674 aa, Homo sapiens
MFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 878647 - protein, 684 aa, Homo sapiens
MDQHQHLNKTAESASSEKKKTRRCNGFKMFLAALSFSYIAKALGGIIMGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 878648 - protein, 447 aa, Homo sapiens
SGWSGREMMADEEEEVKPILQKLQELVDQLYSFRDCYFETHSVEDAGRKQQDVRKEMEKTLQQMEEVVGSVQGKAQVLMLTGKALNVTPDYSPKAEELLSKAVKLEPELVEAWNQLGEVYWKKGDVAAAHTCFSGALTHCRNKVSLQNLSMVLRQLRTDTEDEHSHHVMDSVRQAKLAVQMDVHDGRSWYILGNSYLSLYFSTGQNPKISQQALSAYAQAEKVDRKASSNPDLHLNRATLHKYEESYGEALEGFSRAAALDPAWPEPRQREQQLLEFLDRLTSLLESKGKVKTKKLQSMLGSLRPAHLGPCSDGHYQSASGQKVTLELKPLSTLQPGVNSGAVILGKVVFSLTTEEKVPFTFGLVDSDGPCYAVMVYNIVQSWGVLIGDSVAIPEPNLRLHRIQHKGKDYSFSSVRVETPLLLVVNGKPQGSSSQAVATVASRPQCE

SEQ ID NO: 878649 - protein, 165 aa, Homo sapiens
SGWSGREMMADEEEEVKPILQKLQELVDQLYSFRDCYFETHSVEDAGRKQQDVRKEMEKTLQQMEEVVGSVQGKAQVLMLTGKALNVTPDYSPKAEELLSKAVKLEPELVEAWNQLGEVYWKKGDVAAAHTCFSGALTHVSCPLSLWKAEMGRMNFFGSMSFPRT

SEQ ID NO: 878650 - protein, 447 aa, Homo sapiens; identical to SEQ ID NO: 878648

SEQ ID NO: 878651 - protein, 236 aa, Homo sapiens
SGWSGREMMADEEEEVKPILQKLQELVDQLYSFRDCYFETHSVEDAGRKQQDVRKEMEKTLQQMEEVVGSVQGKAQVLMLTGKALNVTPDYSPKAEELLSKAVKYQSASGQKVTLELKPLSTLQPGVNSGAVILGKVVFSLTTEEKVPFTFGLVDSDGPCYAVMVYNIVQSWGVLIGDSVAIPEPNLRLHRIQHKGKDYSFSSVRVETPLLLVVNGKPQGSSSQAVATVASRPQCE

SEQ ID NO: 878652 - protein, 122 aa, Homo sapiens
SSPPARYHEKHFLFPFALSLVFLHINPEHIHKHVHTFSQISTYLHLYKCHVFNLTSPPRPNSLFKKNSHSYSMYHLIYSLPMVCIVLCCISYAYMVLYGLTYLPGCKLLEIRDLIFSHVSLV

SEQ ID NO: 878653 - protein, 621 aa, Homo sapiens
CARGGSGGGDRSWGRVGSEGGGGERGRRRAVRDAFPVLNYEPRVCRWGCSAAPVAEGEQRRRGATGSGGSGGAEAAEVRAAMQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 878654 - protein, 428 aa, Homo sapiens
MNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 878655 - protein, 621 aa, Homo sapiens; identical to SEQ ID NO: 878653

SEQ ID NO: 878656 - protein, 396 aa, Homo sapiens
CARGGSGGGDRSWGRVGSEGGGGERGRRRAVRDAFPVLNYEPRVCRWGCSAAPVAEGEQRRRGATGSGGSGGAEAAEVRAAMQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFVDTISSKKKKTKKQKNLW

SEQ ID NO: 878657 - protein, 328 aa, Homo sapiens
CARGGSGGGDRSWGRVGSEGGGGERGRRRAVRDAFPVLNYEPRVCRWGCSAAPVAEGEQRRRGATGSGGSGGAEAAEVRAAMQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVSNKIFGSIKNTFMFLITVLEITISCYYFA

SEQ ID NO: 878658 - protein, 540 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 878659 - protein, 428 aa, Homo sapiens; identical to SEQ ID NO: 878654

SEQ ID NO: 878660 - protein, 231 aa, Homo sapiens
MYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 878661 - protein, 608 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 878662 - protein, 616 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTVSFASSQQEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 878663 - protein, 616 aa, Homo sapiens; identical to SEQ ID NO: 878662

SEQ ID NO: 878664 - protein, 515 aa, Homo sapiens
NRPSSNSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 878665 - protein, 628 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLSHRRPEPPPLLEKGAQRRRKRRGTTVESAVPARPLRIPETKGRKTLRLTVTELVNVGTETHTSYSRPLPYTTASLSVLEPQNNICHLWWNELVIDG

SEQ ID NO: 878666 - protein, 544 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRKLLLLLYPACP

SEQ ID NO: 878667 - protein, 268 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEPNSYFQRIYNHPPHPTMSVDEVL

SEQ ID NO: 878668 - protein, 616 aa, Homo sapiens; identical to SEQ ID NO: 878662

SEQ ID NO: 878669 - protein, 255 aa, Homo sapiens
MPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 878670 - protein, 611 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLSHRRPEPPPLLEKGAQRRRKRRGTTVESAVPARPLRIPETKKIGMLIIPCSGGCPKLCCAVWQPPPYGATKHLQCAAWN

SEQ ID NO: 878671 - protein, 345 aa, Homo sapiens
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAMLKSSKDKINANPSIHTFLFP

SEQ ID NO: 878672 - protein, 85 aa, Homo sapiens
LRGTGDFDLCRETIQPFMNKTNETQTSLNGVYQPPIHFQNSEFYGFSEFYYCTEDVLRMGGDYNAAKFTKAAKVPLRDAVCSACF

SEQ ID NO: 878673 - protein, 475 aa, Homo sapiens
RARAHQLPVPSVSDFLEEFPGEGRECVNCGALSTPLWRRDGTGHYLCNACGLYHKMNGVNRPLVRPQKRLSSSRRAGLCCTNCHTTNTTLWRRNSEGEPVCNACGLYMKLHGVPRPLAMKKESIQTRKRKPKTIAKARGSSGSTRNASASPSAVASTDSSAATSKAKPSLASPVCPGPSMAPQASGQEDDSLAPGHLEFKFEPEDFAFPSTAPSPQAGLRGALRQEAWCALALARSPGQPMSGEQPGTDHPLSHLRACFAPAQQRPAGPPTQRLGLLESPHSGGEAFWTDGIGPQSKKAGEGRAQLPTPRTARDSPGAAQGSGPHWPPAAEANAGHHHHQLEFRHQCSPSICLQVVAVGGKQSTSQCKTKIPSEAPEAKQGRGMRGAAGHGPPEASGLSFIAHMDRRSCGAENFSRNRCRTARDRSAGRARCQDSAEGKPLTLQSSQTYALVWTVFPEGMGKGLVLAESVYHDHF

SEQ ID NO: 878674 - protein, 109 aa, Homo sapiens
GNRSEIPGRTTITKFGAGSPLASPLHTGLDDTLMSDAGERHPTRRSCEWPVMYVRRPQGAEERGRQPQGPAGSTSSPPSGCCPSTTSPDFSSNARNLDFKSSNLIQKYF

SEQ ID NO: 878675 - protein, 387 aa, Homo sapiens
AKEATPGHTTHACGVTVRSPNLSGPGPEETRYMAGRGSEATPDPSVNTPSSLPGSTRNASASPSAVASTDSSAATSKAKPSLASPVCPGPSMAPQASGQEDDSLAPGHLEFKFEPEDFAFPSTAPSPQAGLRGALRQEAWCALALARSPGQPMSGEQPGTDHPLSHLRACFAPAQQRPAGPPTQRLGLLESPHSGGEAFWTDGIGPQSKKAGEGRAQLPTPRTARDSPGAAQGSGPHWPPAAEANAGHHHHQLEFRHQCSPSICLQVVAVGGKQSTSQCKTKIPSEAPEAKQGRGMRGAAGHGPPEASGLSFIAHMDRRSCGAENFSRNRCRTARDRSAGRARCQDSAEGKPLTLQSSQTYALVWTVFPEGMGKGLVLAESVYHDHF

SEQ ID NO: 878676 - protein, 115 aa, Homo sapiens
RVRGGAVPGAGRRSLGWGLPGNGLGLPRTPPVSRILFPPAPWRWMPDWKPEWDAADAEAALLVSYRPVLPILPLRCLPRLLRAPPPGAGRVPAGPQEGGGPRAGETRPRTVHFGK

SEQ ID NO: 878677 - protein, 183 aa, Homo sapiens
MLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 878678 - protein, 340 aa, Homo sapiens
MAEETCLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 878679 - protein, 478 aa, Homo sapiens
SVSGAGLYRALGGGALAGDCLETGWACLGRRRCRGFSFRPLHGGGCLTGSPSGMRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 878680 - protein, 70 aa, Homo sapiens
LPSGSALLAGAAGRLGPGPRTRLSSPGLPAGPEKRFAPYSLSSQPLARNWRMVLILTQISHAVPAPDPRG

SEQ ID NO: 878681 - protein, 496 aa, Homo sapiens
SVSGAGLYRALGGGALAGDCLETGWACLGRRRCRGFSFRPLHGGGCLTGSPSGMRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 878682 - protein, 173 aa, Homo sapiens
SVSGAGLYRALGGGALAGDCLETGWACLGRRRCRGFSFRPLHGGGCLTGSPSGMRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIVQAGSVSAHKTF

SEQ ID NO: 878683 - protein, 313 aa, Homo sapiens
HIIHINGEVPWYYSWTSDEAVTVFFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 878684 - protein, 518 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKNIPRKFGGSLSTICPRDHKALLGLVKEINRCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 878685 - protein, 488 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 878686 - protein, 488 aa, Homo sapiens; identical to SEQ ID NO: 878685

SEQ ID NO: 878687 - protein, 488 aa, Homo sapiens; identical to SEQ ID NO: 878685

SEQ ID NO: 878688 - protein, 193 aa, Homo sapiens
SSSSPLWLLPPADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 878689 - protein, 271 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKVRPLPLHSPSG

SEQ ID NO: 878690 - protein, 240 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQGTALDRTDLPNMPAQPTLPQ

SEQ ID NO: 878691 - protein, 518 aa, Homo sapiens; identical to SEQ ID NO: 878684

SEQ ID NO: 878692 - protein, 518 aa, Homo sapiens; identical to SEQ ID NO: 878684

SEQ ID NO: 878693 - protein, 488 aa, Homo sapiens; identical to SEQ ID NO: 878685

SEQ ID NO: 878694 - protein, 529 aa, Homo sapiens
MSLARGEVSADAKALIAKLRISLYYINEEEHVVYKQWYVPEQDVSDSEVRAPSVASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 878695 - protein, 297 aa, Homo sapiens
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSTTPCTSLHSEINDNVRGR

SEQ ID NO: 878696 - protein, 177 aa, Homo sapiens
ACAVRLAAGVRRWAEPTMAAERKTKLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 878697 - protein, 72 aa, Homo sapiens
ACAVRLAAGVRRWAEPTMAAERKTKLSKNLLRMKFMQRGLDSETKKQLEEEEKKIISEEHWYLDLPELKEKE

SEQ ID NO: 878698 - protein, 177 aa, Homo sapiens; identical to SEQ ID NO: 878696

SEQ ID NO: 878699 - protein, 187 aa, Homo sapiens
MCGEARGRSAALGGTYHGGREKDKVVQESAAHEGAGTLREPRRAFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 878700 - protein, 159 aa, Homo sapiens
ACAVRLAAGVRRWAEPTMAAERKTKLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDD

SEQ ID NO: 878701 - protein, 177 aa, Homo sapiens; identical to SEQ ID NO: 878696

SEQ ID NO: 878702 - protein, 177 aa, Homo sapiens; identical to SEQ ID NO: 878696

SEQ ID NO: 878703 - protein, 142 aa, Homo sapiens
MQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 878704 - protein, 1405 aa, Homo sapiens
GKGGGVSNRELDPLAAAAMAARSPPSPHPSPPARQLGPRSPRVGRGAEVHAMRSEASGFAGAAREVVADESDTPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQSLTLSPRLKCNGAIMAHQNLRLPDSSSSASAS

SEQ ID NO: 878705 - protein, 1412 aa, Homo sapiens
GKGGGVSNRELDPLAAAAMAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKTRPAFSMQLLAMRIGHVKLNLDLAGLRKEKEDLLKKLESSSEITSLAEENSQNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 878706 - protein, 779 aa, Homo sapiens
EELDELKVHISMEFEERGGAPKKAIQELNRCGQTGEGGKSKGVGNGSKRNTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 878707 - protein, 1423 aa, Homo sapiens
GKGGGVSNRELDPLAAAAMAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQSLTLSPRLKCNGAIMAHQNLRLPDSSSSASAS

SEQ ID NO: 878708 - protein, 1424 aa, Homo sapiens
GKGGGVSNRELDPLAAAAMAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 878709 - protein, 221 aa, Homo sapiens
GKGGGVSNRELDPLAAAAMAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVERRPPEDVYHQNEEYTKKDKKLGLRKCEIQHMNNIKIFQGEDERRLRRLGSSSSQ

SEQ ID NO: 878710 - protein, 407 aa, Homo sapiens
MAGEASESWREVKSTSYMVVARENEEEAKVETPDKPIRSHETYYHENSTGKTGPPDSMPPPGSLPQHVGIPEDKFKLQFQWGHSQTRRQVAPALSPGGHPCGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVDQLIWLLCLFEMAQTCFSKKTKFPLVVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 878711 - protein, 535 aa, Homo sapiens
MLAASALAAVVPPALSAGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFRKTSEYHDIMYPAWTFGKGDLLFGHFILQVSAVGPPQYKICKVKQHTWPMEKEKLSKHSGHGNMPVSGMSLRPRRACAQLLWHPAAGMASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 878712 - protein, 535 aa, Homo sapiens; identical to SEQ ID NO: 878711

SEQ ID NO: 878713 - protein, 535 aa, Homo sapiens; identical to SEQ ID NO: 878711

SEQ ID NO: 878714 - protein, 214 aa, Homo sapiens
TLAVLNSPVRECLSSHASKNNINGASRSQRGYSLTDPAWLCVQSLTKNCRNEVALLCMVSLRNEELWSSSLRHGLRTGKRHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 878715 - protein, 386 aa, Homo sapiens
MLAASALAAVVPPALSAGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFRKTSEYHDIMYPAWTFGKGDLLFGHFILQVSAVGPPQYKICKVKQHTWPMEKEKLSKHSGHGNMPVSGMSLRPRRACAQLLWHPAAGMASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAGKSAMSYQSKIPC

SEQ ID NO: 878716 - protein, 346 aa, Homo sapiens
KKAKAVGNPGSRRTNFPGASSWTRMSLRPRRACAQLLWHPAAGMASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 878717 - protein, 328 aa, Homo sapiens
KKAKAVGNPGSRRTNFPGASSWTRMSLRPRRACAQLLWHPAAGMASWAKGRSYLAPGLLQGQVAIVTGGATGIGRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 878718 - protein, 95 aa, Homo sapiens
LIYEIPWNLPVGKVAVDEYESLRCEELHLHAENLSRRVWELLMLLPTCPNMLMAFQNISDEQSNDGFNWKELLKIKSAHKLLYALEIIEALGKPN

SEQ ID NO: 878719 - protein, 1122 aa, Homo sapiens
MRRKNSYYVWQKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPG

SEQ ID NO: 878720 - protein, 1394 aa, Homo sapiens
MRRKNSYYVWQKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQRKKSLEEQLHHLGHLQLVLKAVIIAIHIKVEVVTLKWMSNLLIEPNMCNNDFQTQRNPCREVLTKLPTVVKMEAVVLVAVVGIVMDLAMRLILATQASQLGALAVRYSQKTLQILKPSKRKMKTMIMVIILPKAVVVQIFGIESSESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSFKAQSDHRSRHEVSHYSMWLLVSWAHCCSLVKSSLADSDHLQDWLKKLTLLIPETAVCHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQVSVKIIKCFYEM

SEQ ID NO: 878721 - protein, 1300 aa, Homo sapiens
MRRKNSYYVWQKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPN

SEQ ID NO: 878722 - protein, 1630 aa, Homo sapiens
MCENCADLVEVLNEISDVEGGDGLQLRKEHTLKIFTYINSWTQRQCLCCFKEYKHLEIFNQVVCALINLVIAQVQVLRDQLCKHCTTINIDSTWQDESNQAEEPLNIDRECNEGSTERQKSIEKKSNSTRICNLTEEESSKSSDPFSLWSTDEKEKLLLCVAKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQISQMSRVLKAQSDHRSRHEVSHYSMWLLVSWAHCCSLVKSSLADSDHLQDWLKKLTLLIPETAVCHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQVSVKIIKCFYEM

SEQ ID NO: 878723 - protein, 1273 aa, Homo sapiens
MRRKNSYYVWQKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSFKSSV

SEQ ID NO: 878724 - protein, 1406 aa, Homo sapiens
MKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGTSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSFKAQSDHRSRHEVSHYSMWLLVSWAHCCSLVKSSLADSDHLQDWLKKLTLLIPETAVCHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQVSVKIIKCFYEM

SEQ ID NO: 878725 - protein, 359 aa, Homo sapiens
LYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVCHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQVSVKIIKCFYEM

SEQ ID NO: 878726 - protein, 266 aa, Homo sapiens [sequence omitted]

SEQ ID NO: 878727 - protein, 613 aa, Homo sapiens [sequence omitted]

SEQ ID NO: 878728 - protein, 167 aa, Homo sapiens
MNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 878729 - protein, 105 aa, Homo sapiens
MIQSDKGADPPDKKDMKLSTATNPQNGLSQILRLVLQELSLFYSRDVNGVCLLYDLLHSPWLQALLKIYDCLQEFKEKKLVPATPHAQVLSYEVKEILFHRIVEL

SEQ ID NO: 878730 - protein, 593 aa, Homo sapiens [sequence omitted]

SEQ ID NO: 878731 - protein, 550 aa, Homo sapiens
MIQSDKGADPPDKKDMKLSTATNPQNGLSQILRLVLQELSLFYSRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLYEETFESDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKF

SEQ ID NO: 878732 - protein, 282 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGFTKGRKKRGRETI

SEQ ID NO: 878733 - protein, 119 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKDPAGLLARCPIKVNWKFLDF

SEQ ID NO: 878734 - protein, 282 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGCFAIWMSMGEVGL

SEQ ID NO: 878735 - protein, 282 aa, Homo sapiens; identical to SEQ ID NO: 878732

SEQ ID NO: 878736 - protein, 282 aa, Homo sapiens; identical to SEQ ID NO: 878732

SEQ ID NO: 878737 - protein, 205 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSFTKGRKKRGRETI

SEQ ID NO: 878738 - protein, 73 aa, Homo sapiens
HEYDRWEEKVRDARGDWCTDRRRSVAKRYWSVGGGCRMDGQYRVGMLREQVSMETNDEKRKEMWERRGGSERQ

SEQ ID NO: 878739 - protein, 111 aa, Homo sapiens
MAPACHVSSGDPLIVILPKCSFPENGLIRPVKASGSIIKSHGPTYLPLLGCMQVGHLSHALEEEGSQTEVFFPTLGPRCPLLTALWASLLPVWLVHCSLPSRKRALPSIAE

SEQ ID NO: 878740 - protein, 321 aa, Homo sapiens
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKVTSVQNHITAFAEVT

SEQ ID NO: 878741 - protein, 321 aa, Homo sapiens; identical to SEQ ID NO: 878740

SEQ ID NO: 878742 - protein, 119 aa, Homo sapiens
RKEAESCDCLQGFQLTHSLGGGTGSGMGTLLISKIREEYPDRIINTFSILPSPKGVSEQFTAMFRRKAFLHWYTGEGMDEMEFTEAESNMNDLVSEYQQYQDATAKEEEDEEYAEEEVA

SEQ ID NO: 878743 - protein, 99 aa, Homo sapiens
PDNVKTAVCDIPPRGLKMSGSFIGNNAAIQELFTCVSEQFTAMFRRKAFLHWYTGEGMDEMEFTEAESNMNDLVSEYQQYQDATAKEEEDEEYAEEEVA

SEQ ID NO: 878744 - protein, 74 aa, Homo sapiens
RKEAESCDCLQGFQLTHSLGGGTGSGMGTLLISKIREEYPDRIINTFSILPSPKVSDTVVEPYNATLSVHQLIE

SEQ ID NO: 878745 - protein, 145 aa, Homo sapiens
MAAPSPGPREVLAPSPEAGCRAVTSSRRGLLWRLRDKQSRLGLFEISPGHELHGMTCMMQAGLWAATQVSMDHPPTGPPSRDDFSEVLTQVHEGFELGTLAGPAFAWLRRSLGLAEEDYQAALGPGGPYLQFLSTSKSKASFFLS

SEQ ID NO: 878746 - protein, 254 aa, Homo sapiens
MRTSQGRVQVPRILRRRRGLALGLAPDAPRVVEFGDPHPAPSPLPGVHSLRVDRGKKTYFIVMQSVFYPAGRISEREYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 878747 - protein, 395 aa, Homo sapiens
MAAPSPGPREVLAPSPEAGCRAVTSSRRGLLWRLRDKQSRLGLFEISPGHELHGMTCMMQAGLWAATQVSMDHPPTGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKTYFIVMQSVFYPAGRISEREYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 878748 - protein, 347 aa, Homo sapiens
ESGNVPGLNSWPGAGDPEWMRYTQALPWVTLVPLASLEGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKTYFIVMQSVFYPAGRISEREYDIKGCEVSRWVDPAPEGSPLVLVLKDLNFQGKTINLDGTGYHLPPGLNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 878749 - protein, 254 aa, Homo sapiens; identical to SEQ ID NO: 878746

SEQ ID NO: 878750 - protein, 217 aa, Homo sapiens
MAAPSPGPREVLAPSPEAGCRAVTSSRRGLLWRLRDKQSRLGLFEISPGHELHGMTCMMQAGLWAATQVSMDHPPTGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKTYFIVMQSVFYPAGRISER

SEQ ID NO: 878751 - protein, 208 aa, Homo sapiens [sequence omitted]

SEQ ID NO: 878752 - protein, 386 aa, Homo sapiens
ESGNVPGLNSWPGAGDPEWMRYTQALPWVTLVPLASLEGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKVGEAEGGGWAERAAGGRQPASLTPCPGPQTYFIVMQSVFYPAGRISEREYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 878753 - protein, 248 aa, Homo sapiens
LGVGSGRDPDQPRKGPGAADLEKEAWPGAGIGAGCTPGCGVWGSSSGALSPSRSAQSAGGPGKEDVLHRHAERLLPRRPHLREVRGRVCGAPWLAHDERSGGGTDAPAGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 878754 - protein, 231 aa, Homo sapiens
SGARMRGRLCVGRAAAAAAAVAVPLAGGQEGSPGGGRRGSRGTTMVKKRKGRVVIDSDTEDSGSDENLDQELLSLAKRKRSDSEEKEPPVSQPAASSDSETSDSDDEWTFGSNKNKKKGKARKIEKKGTMKKQANKTASSGSSDKDSSAESSAPEEGEVSDSDSNSSSSSSDSDSSSEDEEFHDGYGEDLMGDEEDRARLEQMTEKEREQELFNRIEKREVLKRRLKSRKN

SEQ ID NO: 878755 - protein, 714 aa, Homo sapiens
SGARMRGRLCVGRAAAAAAAVAVPLAGGQEGSPGGGRRGSRGTTMVKKRKGRVVIDSDTEDSGSDENLDQELLSLAKRKRSDSEEKEPPVSQPAASSDSETSDSDDEWTFGSNKNKKKGKARKIEKKGTMKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878756 - protein, 524 aa, Homo sapiens
MGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878757 - protein, 714 aa, Homo sapiens; identical to SEQ ID NO: 878755

SEQ ID NO: 878758 - protein, 336 aa, Homo sapiens
MPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878759 - protein, 125 aa, Homo sapiens
MKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878760 - protein, 714 aa, Homo sapiens; identical to SEQ ID NO: 878755

SEQ ID NO: 878761 - protein, 260 aa, Homo sapiens
RRASQDKMTHGLEMSPTRILVHDECLEILTILIIYTARGRSSTYVCLPRNEEYRGIAQLTGRVELNMKHSIQTSECQNRGSEYSKLTAPEDWKREQELFNRIEKREVLKRRFEIKKKLKTAKKKEKKEKKKKQEEEQEKKKLTQIQESQVTSHNKERRSKRDEKLDKKSQAMEELKAELLAKKQPLKTMNVLLFPWVQPTASWLNVELLFLTQYTSLFLVILFCCFGKNYILFLREISEYECGEQTQKDLGYAGCSSSRL

SEQ ID NO: 878762 - protein, 714 aa, Homo sapiens; identical to SEQ ID NO: 878755

SEQ ID NO: 878763 - protein, 714 aa, Homo sapiens; identical to SEQ ID NO: 878755

SEQ ID NO: 878764 - protein, 585 aa, Homo sapiens
MKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878765 - protein, 562 aa, Homo sapiens
MTSTGVLGPWIKRISCLYKKSKGPEIKRKERLKGGTKIERRKWLRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 878766 - protein, 714 aa, Homo sapiens; identical to SEQ ID NO: 878755

SEQ ID NO: 878767 - protein, 80 aa, Homo sapiens
AAFLFTFQGQGKDKDLNSKSASDLSEDLFKVHDFDVKIDLQVPSSESKALAITSKAPPAKDGAPRRSLNLEDYKKRRGLI

SEQ ID NO: 878768 - protein, 714 aa, Homo sapiens; identical to SEQ ID NO: 878755

SEQ ID NO: 878769 - protein, 149 aa, Homo sapiens
MSYLLVSLVWSERPSLAHLPRALGSWCAGCQPGSPALLGDAPGLRGPGWLWSRDSWGRGPASDCPGPQPPPLQGIGVMCSIIGWGVCVCVCVCVYVCMRLAHGKAQANPAPRRWAATLPPKHGDVAAALGPPVGPMGEELPFAGVGSLP

SEQ ID NO: 878770 - protein, 287 aa, Homo sapiens
ADSRGYTCNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYD

SEQ ID NO: 878771 - protein, 642 aa, Homo sapiens
LEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYD

SEQ ID NO: 878772 - protein, 243 aa, Homo sapiens
RYPSSADAALAPQQTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYD

SEQ ID NO: 878773 - protein, 453 aa, Homo sapiens
HFFLKIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYD

SEQ ID NO: 878774 - protein, 100 aa, Homo sapiens
MDGRVQDGAGNLAVVVTLCMNPGPGTWTSCDRPYRPVRLSLALPKTTQSMRGGAGVQAAHQAVTTMVAAGDGHRHELKPGAALTLREGSMLPLPTAAVRP

SEQ ID NO: 878775 - protein, 110 aa, Homo sapiens
CGPRDPPASLPAPRRLSGLCARRRSQASLSAGVARADAPLCSGFRAGHACGTGTQPQPTLSSRSSSLTSAEVQLPQFLAQVDNYRHKPLKLECPVAGISIDLSQLSLQLQ

SEQ ID NO: 878776 - protein, 110 aa, Homo sapiens; identical to SEQ ID NO: 878775

SEQ ID NO: 878777 - protein, 110 aa, Homo sapiens; identical to SEQ ID NO: 878775

SEQ ID NO: 878778 - protein, 110 aa, Homo sapiens; identical to SEQ ID NO: 878775

SEQ ID NO: 878779 - protein, 399 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878780 - protein, 399 aa, Homo sapiens; identical to SEQ ID NO: 878779

SEQ ID NO: 878781 - protein, 263 aa, Homo sapiens [sequence omitted]

SEQ ID NO: 878782 - protein, 128 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNPCWYRGL

SEQ ID NO: 878783 - protein, 310 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLRGQPAAAARGAGEARGLLHSLRNLPHPGEAEDHHLQEPL

SEQ ID NO: 878784 - protein, 354 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKAVFVTFCSSLCKKRILNLYTWHVLHYIFQDTSIFIY

SEQ ID NO: 878785 - protein, 397 aa, Homo sapiens
MRLTDVVQQLVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878786 - protein, 439 aa, Homo sapiens
RVVTICYILIVLSSFKVGENEFSPVWHSVYCCRFYSNRIFYFLLRFPFQMFQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878787 - protein, 263 aa, Homo sapiens [sequence omitted]

SEQ ID NO: 878788 - protein, 232 aa, Homo sapiens
MLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878789 - protein, 222 aa, Homo sapiens
MEKQINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878790 - protein, 168 aa, Homo sapiens
NGDNAQRQMTGTPQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878791 - protein, 79 aa, Homo sapiens
LRFRHLRHNLFNINTAIHGTRQRLHIASASEAGGQQAEPISSPVHGVLKVHGAPRTGEQLFLSTLVVLMRPVRYCNKAP

SEQ ID NO: 878792 - protein, 399 aa, Homo sapiens; identical to SEQ ID NO: 878779

SEQ ID NO: 878793 - protein, 358 aa, Homo sapiens
MAAVPHRTHAVDYLGLETRKHWASCSFLQLERNDSVLEQKLVSALSLGSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878794 - protein, 399 aa, Homo sapiens; identical to SEQ ID NO: 878779

SEQ ID NO: 878795 - protein, 287 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVR

SEQ ID NO: 878796 - protein, 357 aa, Homo sapiens
MASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878797 - protein, 386 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878798 - protein, 179 aa, Homo sapiens [sequence omitted]

SEQ ID NO: 878799 - protein, 206 aa, Homo sapiens
MTTNRVSVPDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 878800 - protein, 156 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDT

SEQ ID NO: 878801 - protein, 549 aa, Homo sapiens
QACLALPGTMSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSVRFPARDSRLRLPGVRSSDLR

SEQ ID NO: 878802 - protein, 501 aa, Homo sapiens
QACLALPGTMSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSVRTGLGAGPAGAGPGGARRGQEAPDCG

SEQ ID NO: 878803 - protein, 263 aa, Homo sapiens
METEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATSDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 878804 - protein, 556 aa, Homo sapiens
PTRLAAGRLCGSASRLLRIGSAQLGEKMFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 878805 - protein, 556 aa, Homo sapiens; identical to SEQ ID NO: 878804

SEQ ID NO: 878806 - protein, 407 aa, Homo sapiens
RSVGAGSLKPVNMAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 878807 - protein, 289 aa, Homo sapiens
RSVGAGSLKPVNMAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSSQGANFSRVNRIWHGSSMVILLSGLEEYQCNNMTCASWFSYGH

SEQ ID NO: 878808 - protein, 407 aa, Homo sapiens; identical to SEQ ID NO: 878806

SEQ ID NO: 878809 - protein, 311 aa, Homo sapiens
MLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 878810 - protein, 407 aa, Homo sapiens; identical to SEQ ID NO: 878806

SEQ ID NO: 878811 - protein, 407 aa, Homo sapiens; identical to SEQ ID NO: 878806

SEQ ID NO: 878812 - protein, 115 aa, Homo sapiens
ILGLCYQYIFRIPPSTPRSKRLLSDDRSNILIYMTGHGGNGFLKFQDSEEITNIELADAFEQMWQKRRYNELLFIIDTCQGASMYERFYSPNIMALASSQVGEDSLSHSRYVHFP

SEQ ID NO: 878813 - protein, 407 aa, Homo sapiens; identical to SEQ ID NO: 878806

SEQ ID NO: 878814 - protein, 235 aa, Homo sapiens [sequence omitted]

SEQ ID NO: 878815 - protein, 407 aa, Homo sapiens; identical to SEQ ID NO: 878806

SEQ ID NO: 878816 - protein, 209 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 878817 - protein, 209 aa, Homo sapiens; identical to SEQ ID NO: 878816

SEQ ID NO: 878818 - protein, 209 aa, Homo sapiens; identical to SEQ ID NO: 878816

SEQ ID NO: 878819 - protein, 209 aa, Homo sapiens; identical to SEQ ID NO: 878816

SEQ ID NO: 878820 - protein, 209 aa, Homo sapiens; identical to SEQ ID NO: 878816

SEQ ID NO: 878821 - protein, 155 aa, Homo sapiens
ARVALPPVLRSRWWPPGRSGRWVPRSTSAGPPPACCSLAGGCFAATVHPAQTSLTPPSILLPALLLPATTCKVPRLHSVPLCFVLPWTELSAGCDPRRALPRATGCWGLGTGQRLSQAGRQQPSASLAHSDNFPRPPPASKNRVHPPLDIGEGRK

SEQ ID NO: 878822 - protein, 89 aa, Homo sapiens
LVPARDVRDRLEGTGSAHTCWLAHQDWLYLLTHGAKVHSANVKSVPSAWNPTAPTAGSPQPSRSSTPADAEQWPQDSLPHPLQPRAPGD

SEQ ID NO: 878823 - protein, 209 aa, Homo sapiens; identical to SEQ ID NO: 878816

SEQ ID NO: 878824 - protein, 209 aa, Homo sapiens; identical to SEQ ID NO: 878816

SEQ ID NO: 878825 - protein, 109 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAASRPCSLSRRWGPAYTLP

SEQ ID NO: 878826 - protein, 71 aa, Homo sapiens
MASMGLQVMGIALAVLGWLAVMLCCALPMWRVTAFIGSNIVTSQTIWEGLWMNCVSLESYRERTAMGFVFF

SEQ ID NO: 878827 - protein, 860 aa, Homo sapiens
SDLAGGRGLGVRSPTSSALRTPKSPPDPPLDIPRVSDSETEGEDGGASPPAPQKMQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878828 - protein, 806 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878829 - protein, 806 aa, Homo sapiens; identical to SEQ ID NO: 878828

SEQ ID NO: 878830 - protein, 780 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIIRVRSAHQVPGLWELISTHHEIEFSQPPQGCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878831 - protein, 552 aa, Homo sapiens [sequence omitted]

SEQ ID NO: 878832 - protein, 836 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKLDQSDTPPALRREPVLRGWCGEKPTYPEQRVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878833 - protein, 370 aa, Homo sapiens [sequence omitted]

SEQ ID NO: 878834 - protein, 273 aa, Homo sapiens [sequence omitted]

SEQ ID NO: 878835 - protein, 294 aa, Homo sapiens
WGGGWESCTCHQAPSPCHQPTRCTGLYWLRTGIAGELSGPWQVRKVPGKSSAVPAFHQDELARECGFVGPASEEFPASPLPAPPAPNTHTLRSGVHGFYASPLCHWAALLPRPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878836 - protein, 477 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLEPLNQPLRQVNPQPKGPGIGLGLGGFAR

SEQ ID NO: 878837 - protein, 129 aa, Homo sapiens
NRFFHWISLSKKPTFAELCPQGWTNLTLLQHCRREPVLRGWCGEKPTYPEQRLEWALCYPRPWGVNCGERERWMGGWLSRPPASFLSRVMLTGTLSDRQPAELHLFRNYDAPETVREPRFNQNVNLRPP

SEQ ID NO: 878838 - protein, 202 aa, Homo sapiens
RAGFLQAAETVRLSDTSQSNSPIACGWGAWDPEWEASPKIIQQIGSRACSEANKRGSGRAQRLTPVIPALWEAEGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878839 - protein, 113 aa, Homo sapiens
WGGGWESCTCHQAPSPCHQPTRCTGLYWLRTGIAGELSGPWQVRKVPGKSSAVPAFHQDELARECGFVGPASEEFPASPLPAPPAPNTHTLRSGVHGFYASPLCHWAALLPRP

SEQ ID NO: 878840 - protein, 752 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878841 - protein, 840 aa, Homo sapiens
MRLKLESDTRACVIVLMCKTEGEDGGASPPAPQKMQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878842 - protein, 700 aa, Homo sapiens
TTAPQPGLQSKTLSQKTKLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878843 - protein, 848 aa, Homo sapiens
SDLAGGRGLGVRSPTSSALRTPKSPPDPPLDIPRVSDSETEGEDGGASPPAPQKMQFFGRLVNTFSGVTNLFSNPFRVKEVAVADYTSSDRVREEGQLILFQNTPNRTWDCVLVNPRNSQSGFRSHAQELTVNQRTLCGTTGWSRGANTLWALPSLDSGWLLRLERLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878844 - protein, 853 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTAEPEPLRGEVTSQGHTDHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKLDQSDTPPALRREPVLRGWCGEKPTYPEQRVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878845 - protein, 558 aa, Homo sapiens
MRAPLRSCTLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 878846 - protein, 469 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLNYRISCTSHGPGSQRSSWAP

SEQ ID NO: 878847 - protein, 451 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLAT

SEQ ID NO: 878848 - protein, 333 aa, Homo sapiens
QAPQCTSGRVTRSGGSRLDRSSLLVEMSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 878849 - protein, 333 aa, Homo sapiens; identical to SEQ ID NO: 878848

SEQ ID NO: 878850 - protein, 213 aa, Homo sapiens
QAPQCTSGRVTRSGGSRLDRSSLLVEMSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSGTFAESP

SEQ ID NO: 878851 - protein, 273 aa, Homo sapiens
QAPQCTSGRVTRSGGSRLDRSSLLVEMSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQVGFLPF

SEQ ID NO: 878852 - protein, 190 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSGEFWISVILF

SEQ ID NO: 878853 - protein, 129 aa, Homo sapiens
KKKKKKKKKKRPPELGSGGSRLDRSSLLVEMSMILSASVIRVRDGLPLSASTDYEQSTGMQECRKYFKMLSRKLAQLPDRCTLKTGHYNIKVMVMILITSLHFSLEQQPAFTSVIYLSTTPAGGMSNLF

SEQ ID NO: 878854 - protein, 268 aa, Homo sapiens
AGTGRKSRIGSRLDRSSLLVEMSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQVGFLPF

SEQ ID NO: 878855 - protein, 328 aa, Homo sapiens
AGTGRKSRIGSRLDRSSLLVEMSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 878856 - protein, 207 aa, Homo sapiens [sequence omitted]

SEQ ID NO: 878857 - protein, 105 aa, Homo sapiens
MHVMDLQRDANRQISDLKFKLAKSEQEITALEQNVIRLESQVSRYKSAAENAEKIEDELKAEKRKLQRELRSALDKTEELEVSNGHLVKRLEKMKANRSALLSQQ

SEQ ID NO: 878858 - protein, 162 aa, Homo sapiens [sequence omitted]

SEQ ID NO: 878859 - protein, 106 aa, Homo sapiens [sequence omitted]

SEQ ID NO: 878860 - protein, 115 aa, Homo sapiens
MLPLCVPFSPSLSGSLISCTHFGLFTKSHISWRFCSLFHRLFSVLSGSAASSPAFRETKTVASLALRGSRAMAHPREPQQPPGASVCRPLARAGADAQNLQVLHKHTGASRELCV

SEQ ID NO: 878861 - protein, 105 aa, Homo sapiens; identical to SEQ ID NO: 878857

SEQ ID NO: 878862 - protein, 120 aa, Homo sapiens
SIYSLVADGTCEDTAIVGNKDPPSIWAAVPGKTFLNITPAEVGVLVGKDWSSFVMNGLTLGGQKYTVVLDSLLQDGELTTDLRMKSIGGAPTFNVIVTMTAKTLGLLMGKEGIHGNFIDK

SEQ ID NO: 878863 - protein, 585 aa, Homo sapiens
AAALSGGGGPGAQAPRPGTPWKSRAYSPGIQGLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 878864 - protein, 585 aa, Homo sapiens; identical to SEQ ID NO: 878863

SEQ ID NO: 878865 - protein, 436 aa, Homo sapiens
METGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 878866 - protein, 149 aa, Homo sapiens
MAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 878867 - protein, 522 aa, Homo sapiens
AAALSGGGGPGAQAPRPGTPWKSRAYSPGIQGLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKV

SEQ ID NO: 878868 - protein, 86 aa, Homo sapiens
NLGMLLVEFFELYGRNFNYLKTGIRIKEGGAYIAKEEIMKAMTSGYRPSMLCIEDPLLPGKGALISTAESWASLGDVLVTGPVLGL

SEQ ID NO: 878869 - protein, 585 aa, Homo sapiens; identical to SEQ ID NO: 878863

SEQ ID NO: 878870 - protein, 542 aa, Homo sapiens
MSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 878871 - protein, 268 aa, Homo sapiens [sequence omitted]

SEQ ID NO: 878872 - protein, 585 aa, Homo sapiens; identical to SEQ ID NO: 878863

SEQ ID NO: 878873 - protein, 430 aa, Homo sapiens
AAALSGGGGPGAQAPRPGTPWKSRAYSPGIQGLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVVSALPSSVCLLDSLCLW

SEQ ID NO: 878874 - protein, 570 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEGGSGLLVGKVGGLRTAGSRSSHGGGWQMETEPSRFGQTCPLSASK

SEQ ID NO: 878875 - protein, 667 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEAPAAAVRRFGEDTAPPSFPSCGHYREEPALGPAKAARQAARDGARLALARAAPECCAPPTPEAPGAPAQLPFVLLNYHRVLARRGPLGGAAPAASGLACAPGGPEAATGALRLRHPSPAATSPPGAPLPHYLGASVIITNGR

SEQ ID NO: 878876 - protein, 419 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPAREEEAF

SEQ ID NO: 878877 - protein, 78 aa, Homo sapiens
MCLGEKERGPDLQRIQGTGSHGCGEELAKGLQCVFSRASAERKAREHKLVIPTNVELSSNVVHSLLEAHVRAGVLGGC

SEQ ID NO: 878878 - protein, 667 aa, Homo sapiens; identical to SEQ ID NO: 878875

SEQ ID NO: 878879 - protein, 542 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEGKQMSSAEIPPAPQDAD

SEQ ID NO: 878880 - protein, 163 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQSSPRQPCSEILPKPGLSAYVVMLDALKRAPQRDMFQSTLAGLHVTVL

SEQ ID NO: 878881 - protein, 92 aa, Homo sapiens
MHKSQIRMEKTQNHHQHQDQKDKNPSKNRKKLLKHLKGPSSVEDIKAKMQASIEKCGSLPKVEAKFISYVKNCFWMTEQEAIQDFWQWRKSL

SEQ ID NO: 878882 - protein, 72 aa, Homo sapiens
RVKEQRGLGRHVRSTGTIPRSRAEVLGGCAGVKWWFSGDGMINKGVRRNRCWKVTKVERDVALALQVRRERE

SEQ ID NO: 878883 - protein, 72 aa, Homo sapiens; identical to SEQ ID NO: 878882

SEQ ID NO: 878884 - protein, 72 aa, Homo sapiens; identical to SEQ ID NO: 878882

SEQ ID NO: 878885 - protein, 115 aa, Homo sapiens
MGNVPQAGLSWASRGARAAWGGPGTGGPCWLALGPLARQSLSSQFLLPWGRRGGPWAAASSIPNHRLGGCSPGGWVLGLGPAAAHRTQWGPQGGEEAALPLPESSSPPRGCVCVS

SEQ ID NO: 878886 - protein, 88 aa, Homo sapiens
ESLARSCRPVRSDWAYFSPQSPQVFFMKPSGREWPCKNGRNLRLEMLGRLRSNGLSRYREAERISSPCIDFDFRLCDFLTPRSESSTG

SEQ ID NO: 878887 - protein, 406 aa, Homo sapiens
RIAEGHCFADLKNKAKSPASASGRRLCLLWEREGHPSPLLRSRLRRHNRGNGSRHHHHRSNLSALAGVQGAAASEWDKRASSSPSSRASGFSDIQAPFQHPFPASPAGTGAPLGVCGFQLNGRRHNETRANRFSAFLPRAFPSRGPASLTRKCWSRYWLSSTEESLRSAFRRPPDIVQRSGPQCGDSRHEAASAMAEAETRGGEHLIGPNPRAACRHQAARGHRRPGRAPRGGRRGRRGRVPGAWRRWCCGGCWPPCCTARSWWNVCQSRGLSDVRRSSRPSHCCRPSCGARTRPAACRTSRLGPWAPCAAALSDLETPSPRSYAAASEAARGHHQVARGALAQTFNPGLCGAEAACFSFRALQWHQCGGVIPGTARGFESRLGLLACRHPTHKSLGQTARSVEVL

SEQ ID NO: 878888 - protein, 104 aa, Homo sapiens
DGVSLCRPGCSTMVQSPLTATPPPRFKRFCCLSLPSSWDYRHAPMRHHARLIFVFLVETGFHHVGQPGLEHLTSGDLPASASQSAGITGMSHAPSLSNLFDHNP

SEQ ID NO: 878889 - protein, 134 aa, Homo sapiens
FPAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 878890 - protein, 484 aa, Homo sapiens
SGAPSRSPPRPRAPKRLGGALSVNIVVHPLPIPSPRGFRLASAQPGSRPGSAMGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 878891 - protein, 450 aa, Homo sapiens
SGAPSRSPPRPRAPKRLGGALSVNIVVHPLPIPSPRGFRLASAQPGSRPGSAMGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 878892 - protein, 450 aa, Homo sapiens; identical to SEQ ID NO: 878891

SEQ ID NO: 878893 - protein, 121 aa, Homo sapiens
MTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 878894 - protein, 248 aa, Homo sapiens
HHRGYKSYRIVSLQRASERNDKPREPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 878895 - protein, 450 aa, Homo sapiens; identical to SEQ ID NO: 878891

SEQ ID NO: 878896 - protein, 313 aa, Homo sapiens
SGAPSRSPPRPRAPKRLGGALSVNIVVHPLPIPSPRGFRLASAQPGSRPGSAMGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPV

SEQ ID NO: 878897 - protein, 323 aa, Homo sapiens
SGAPSRSPPRPRAPKRLGGALSVNIVVHPLPIPSPRGFRLASAQPGSRPGSAMGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVRPREGHELDS

SEQ ID NO: 878898 - protein, 588 aa, Homo sapiens
KQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGYWKVEKICTASLLSEDTHPCDSNSLLTTPSGGSMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 878899 - protein, 209 aa, Homo sapiens [sequence omitted]

SEQ ID NO: 878900 - protein, 412 aa, Homo sapiens
MGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 878901 - protein, 588 aa, Homo sapiens; identical to SEQ ID NO: 878898

SEQ ID NO: 878902 - protein, 124 aa, Homo sapiens
NSTLSSLRVQVSSWVSASPDFLPRPGAEALAMRLMLGRRCPAKLNRYVATGWLSWSFTLSREEHITPSCCGMGVPGSQDSRGHWSTHVFYVQFDLNLRLAILFLLSLVGEQQELGFGCSSRGPS

SEQ ID NO: 878903 - protein, 256 aa, Homo sapiens
RRSRPFPSTGRQEARSKMAVNQSHTENRRGALIPNGESLLKRSPNVELSFPQRSEGSNVFSGRKTGTLFLTSYRVIFITSCSISDPMLSFMMPFDLMTNLTVEQPVFAANFIKGTIQAAPYGGWEGQATFKLVFRNGGAIEFAQLMVKAASAAARGFPLRTLNDWFSSMGIYVITGEGNMCTPQMPCSVIVYGAPPAGYGAPPPGYGAPPAGYGAQPVGNEAAACGIQSLTCAIWSPTSWIRSPTCRIWSPTSRIW

SEQ ID NO: 878904 - protein, 109 aa, Homo sapiens [sequence omitted]

SEQ ID NO: 878905 - protein, 117 aa, Homo sapiens
EGLCRGGAAAEPAARRPISSVRTGSRGSRPSRGRARGAGSPPAVPRSSAGPEPAPPPPPPCRSGRAAREACGRGLHGQRPRPAAEPSRSRAALGARIYTALLWDTPPLDLKDSPRQH

SEQ ID NO: 878906 - protein, 106 aa, Homo sapiens
AGCYWSGDFWMDKDKVSLTKTPKLERGDGGKEVRERASKRKLPFTAGANGEQKDSDTGPPGSCLSWGSHEGALVRSAMGRSCLPSARGCFFGTRGKIMIFLFCFDL

SEQ ID NO: 878907 - protein, 1429 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878908 - protein, 1523 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEKELKPYGSSAINILKEKKKREKHREKWRDEKERHRDRHADGLLRHHRDELLRHHRDEQKPATRDKDSPPRVLKDKSRDEGP

SEQ ID NO: 878909 - protein, 1400 aa, Homo sapiens
MPPAQSLLWCCKAGTLLEAPWHEMEVPRSKKKEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEK

SEQ ID NO: 878910 - protein, 274 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKGWHPPVLHTSGLSWHLGGSVALFPRS

SEQ ID NO: 878911 - protein, 1190 aa, Homo sapiens
MGSRRTRTQVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878912 - protein, 248 aa, Homo sapiens
MESDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKGWHPPVLHTSGLSWHLGGSVALFPRS

SEQ ID NO: 878913 - protein, 274 aa, Homo sapiens; identical to SEQ ID NO: 878910

SEQ ID NO: 878914 - protein, 421 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKIAPPPSLAEPLKELFRQQEAVRGKLRLQHSIEREKLIVSCEQEILRVHCRAARTIANQAVPFSACTMLLDSEVYNMPLESQGDENKSVRDRFNARQFISWLQDVDDKYDRMKTCLLMRQQHEAAALNAVQRMEWQLKVQELDPAGHKSLCVNEVPSFYVPMVDVNDDFVLLPA

SEQ ID NO: 878915 - protein, 806 aa, Homo sapiens
IGGSRGSQFDGDSPLLSWLPFGKGQEEERVRRGRAGQKGRPVRAARERRDGRAKPEEAHREELKECGCESGFKDKSDGDFGKGLEPWERHHPAREKEKKDGPDKERKEKKNQKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878916 - protein, 730 aa, Homo sapiens
RYKEKSSDKDKSEKSILEKCQKDKEFDKVLARGKKIPRKNIKTHMERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878917 - protein, 694 aa, Homo sapiens
ARYPTPPESERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878918 - protein, 387 aa, Homo sapiens
NTVAQAQAADGAGPEDDTEASRAAAPAEGPPGGIQPEAAEPKPTAEAPKAPRVEEIPQRMTRNRAQMLANQSKQGPPPSEKECAPTPAPVTRAKARGSEDDDAQAQHPRKRRFQRSTQQLQQQLNTSTQQTREVIQQTLAAIVDAIKLDAIEPYHSDRANPYFEYLQIRKKIEEKRKILCCITPQAPQCYAEYVTYTGSYLLDGKPLSKLHIPVIAPPPSLAEPLKELFRQQEAVRGKLRLQHSIEREKLIVSCEQEILRVHCRAARTIANQAVPFSACTMLLDSEVYNMPLESQGDENKSVRDRFNARQFISWLQDVDDKYDRMKTCLLMRQQHEAAALNAVQRMEWQLKVQELDPAGHKSLCVNEVPSFYVPMVDVNDDFVLLPA

SEQ ID NO: 878919 - protein, 387 aa, Homo sapiens
MGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEKELKPYGSSAINILKEKKKREKHREKWRDEKERHRDRHADGLLRHHRDELLRHHRDEQKPATRDKDSPPRVLKDKSRDEGP

SEQ ID NO: 878920 - protein, 115 aa, Homo sapiens
VDAIKLDAIEPYHSDRANPYFEYLQIRKKIEEKRKILCCITPQAPQCYAEYVTYTGSYLLDGKPLSKLHIPVVSAGPGRATAFSLWDASGAPSHGFLQPVLSHSWPLTSLDLSAT

SEQ ID NO: 878921 - protein, 277 aa, Homo sapiens
IGGSRGSQFDGDSPLLSWLPFGKGQEEERVRRGRAGQKGRPVRAARERRDGRAKPEEAHREELKECGCESGFKDKSDGDFGKGLEPWERHHPAREKEKKDGPDKERKEKKNQKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKESEGRLEVRPRSYS

SEQ ID NO: 878922 - protein, 101 aa, Homo sapiens
MADHGIPEPLSCLGKNQQDKDKVSLTKTPKLERGDGGKEVRERAISALCQKYPRKHAVLMNFLFTMLREEGGFEYKRAIVDCIISIIEENSESRRSLTDPV

SEQ ID NO: 878923 - protein, 1380 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKGQVHGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878924 - protein, 1469 aa, Homo sapiens
MPKGGCPKAPQQEELPLSSDMVEKQTGKKDKDKVSLTKTPKLERGDGGKEVRERASKRKLPFTAGANGEQKDSDTVLCVDAFRCLQPSPCCGAARLVRSSKHHGMRWRFLEAKKKEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKD

SEQ ID NO: 878925 - protein, 1400 aa, Homo sapiens; identical to SEQ ID NO: 878909

SEQ ID NO: 878926 - protein, 274 aa, Homo sapiens; identical to SEQ ID NO: 878910

SEQ ID NO: 878927 - protein, 1214 aa, Homo sapiens
MRIPNPGPLLTTLHNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEK

SEQ ID NO: 878928 - protein, 1077 aa, Homo sapiens
YGYGYEAGVKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEVHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEK

SEQ ID NO: 878929 - protein, 124 aa, Homo sapiens
MPKGGCPKAPQQEELPLSSDMVEKQTGKKDKDKVSLTKTPKLERGDGGKEVRERASKRKLPFTAGANGEQKDSDTGPPGSCLSWGSHEGALVRSAMGRSCLPSARGCFFGTRGKIMIFLFCFDL

SEQ ID NO: 878930 - protein, 75 aa, Homo sapiens
ATRPVTWIQVYRIKTCLLMRQQHEAAALNAVQRMEWQLKVQELDPAGHKSLCVNEVPSFYVPMVDVNDDFVLLPA

SEQ ID NO: 878931 - protein, 317 aa, Homo sapiens
GRCPPESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEKELKPYGSSAINILKEKKKREKHREKWRDEKERHRDRHADGLLRHHRDELLRHHRDEQKPATRDKDSPPRVLKDKSRDEGP

SEQ ID NO: 878932 - protein, 467 aa, Homo sapiens
PPYQLPSSSLSTFTVNDSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878933 - protein, 451 aa, Homo sapiens
GEFGTREREKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878934 - protein, 551 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVSGPGARLGPPLSRLLSFLPGSSLSPLPTVFLSIKHPDSVSSSDLSGFQVVGVFRPETVASQPSLGEGEESESNSVESLGFCSVLSEDGERGLWEGPGLGAREDGRACEIQALMSLHGTLLWPGMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878935 - protein, 462 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878936 - protein, 443 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDSSLV

SEQ ID NO: 878937 - protein, 560 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGRAPPLSDLSWVQRPNPGIYTSQSSLLGHSRQNLRPAVCSADLLGPKVHSASFLLLNSPVIPGAVSGPFHSSFLSLSPFPCLVYVSVPSALSSSVPSSGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878938 - protein, 388 aa, Homo sapiens
MEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878939 - protein, 345 aa, Homo sapiens
GRVGRPTRPRTRGTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878940 - protein, 315 aa, Homo sapiens
RRLVRGWGVNGRGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878941 - protein, 318 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKHCFSFTFICWCEPWGVYLYVGSRCLRFPFFPFPSLWGWKGGRDTS

SEQ ID NO: 878942 - protein, 290 aa, Homo sapiens
MESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKHCFSFTFICWCEPWGVYLYVGSRCLRFPFFPFPSLWGWKGGRDTS

SEQ ID NO: 878943 - protein, 111 aa, Homo sapiens
PPYQLPSSSLSTFTVNDSGRRLGPEKWIRRLRRMESESESGAAADTPPLETLSFHGDEEIIEVVELDPGPPDPALPRPGGPFRGRGGPVSLSLSFAGVSHGVCICMWGVGV

SEQ ID NO: 878944 - protein, 142 aa, Homo sapiens
PPYQLPSSSLSTFTVNDSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSGRSLRRSTSNQFRWACKH

SEQ ID NO: 878945 - protein, 462 aa, Homo sapiens; identical to SEQ ID NO: 878935

SEQ ID NO: 878946 - protein, 502 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVLSEDGERGLWEGPGLGAREDGRACEIQALMSLHGTLLWPGMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878947 - protein, 352 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSDAPGSCWLPGWDLGHL

SEQ ID NO: 878948 - protein, 462 aa, Homo sapiens; identical to SEQ ID NO: 878935

SEQ ID NO: 878949 - protein, 462 aa, Homo sapiens; identical to SEQ ID NO: 878935

SEQ ID NO: 878950 - protein, 411 aa, Homo sapiens
LASRGLPSCVPRAPADPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878951 - protein, 358 aa, Homo sapiens [sequence omitted]

SEQ ID NO: 878952 - protein, 261 aa, Homo sapiens
RTRGSTHASADAWAVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 878953 - protein, 304 aa, Homo sapiens
RGSSSASSRRADSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKHFRGRGGPVSLSLSFAGVSHGVCICMWGVGV

SEQ ID NO: 878954 - protein, 142 aa, Homo sapiens
PPYQLPSSSLSTFTVNDSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSAFAGVSHGVCICMWGVGV

SEQ ID NO: 878955 - protein, 201 aa, Homo sapiens
PPYQLPSSSLSTFTVNDSGRRLGPEKWIRRLRRMESESESGAAADTPPLETLSFHGDEEIIEVVELDPGPPDPDDLAQEMEDVDFEEEEEEEGNEEEEIEMMKLMGLWPPFDSTKGKEGGWLCTMPMPYNVSQKRKYRQYMNRKGGFNRPWDFMALRIEVLKDDFFSPHLGQRVDRYTAFNWHSKNQDLKFSYPGYGKAKS

SEQ ID NO: 878956 - protein, 103 aa, Homo sapiens
MDASDIWCRDSDRGTSLGRSIPCPPALCSKRKIHLRPLLLRPTSPRNISPILNRALGDGRVTGWKNSVSLNHCMEENWKLPRNTSLGQLCEQEINFFYSVKKN

SEQ ID NO: 878957 - protein, 103 aa, Homo sapiens; identical to SEQ ID NO: 878956

SEQ ID NO: 878958 - protein, 104 aa, Homo sapiens
ACADVDGFVGAGREARGGSWASPVPWRLGLSALRKELGRDLSLPAVRSPSAPRLVVTAALPPATPVMIAMEPRLRWHYYKPKRRGARSNKGKLFSILSSMFLAA

SEQ ID NO: 878959 - protein, 104 aa, Homo sapiens; identical to SEQ ID NO: 878958

SEQ ID NO: 878960 - protein, 408 aa, Homo sapiens
RSCGPPTAGGQRCEEAPGTVMERRLGVRAWVKENRGSFQPPVCNKLMHQEQLKVMFVGGPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQELSPQPSPCLLLSWGSASAPDALGESLPSQGGDPGPESPLPGRGEGGAAAPLGGKGWQTHSCVEPHECVWAPAPDRECGVCVCRWPLRWECSPLLLLPVRPCRFFSSEQYRTGKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 878961 - protein, 254 aa, Homo sapiens
MTIPETVPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQEFFSSEQYRTGKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 878962 - protein, 306 aa, Homo sapiens
RSCGPPTAGGQRCEEAPGTVMERRLGVRAWVKENRGSFQPPVCNKLMHQEQLKVMFVGGPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQEFFSSEQYRTGKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 878963 - protein, 306 aa, Homo sapiens; identical to SEQ ID NO: 878962

SEQ ID NO: 878964 - protein, 306 aa, Homo sapiens; identical to SEQ ID NO: 878962

SEQ ID NO: 878965 - protein, 163 aa, Homo sapiens
MSRLMVSIITSMGIRGVGVPCGKKWARAFLILERKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 878966 - protein, 288 aa, Homo sapiens
RSCGPPTAGGQRCEEAPGTVMERRLGVRAWVKENRGSFQPPVCNKLMHQEQLKVMFVGGPNTRKDYHIEEGEEVFYQLEGDMVLRVLEQGKHRDVVIRQGEIFLLPARVPHSPQRFANTVGLVVERRRLETELDGLRFFSSEQYRTGKPIPGDRLWARQQRRPETECGRVAVAAGKWGPGTGLQNPLPEGISPLLGPGLPHGAHSWGLGAQADSDIHPGDEAQQSPFDSPAPLLQEGSSVVTMGGRRLSLAPDDSLLVLAGTSYAWERTQGSVALSVTQDPACKKPLG

SEQ ID NO: 878967 - protein, 306 aa, Homo sapiens; identical to SEQ ID NO: 878962

SEQ ID NO: 878968 - protein, 196 aa, Homo sapiens
AAFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGIHHGPSVAQPIHLDSTQLSRKFISDYLWSLVDTEW

SEQ ID NO: 878969 - protein, 174 aa, Homo sapiens
AAFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGRGMFECHGVPRLC

SEQ ID NO: 878970 - protein, 174 aa, Homo sapiens; identical to SEQ ID NO: 878969

SEQ ID NO: 878971 - protein, 106 aa, Homo sapiens
MSRDRTTVLQPGLQNETLSQKKKVKAVSFSPWGCVRGCVSRAFLTSVPQSIMAPVWPSPSTWTAPSSPGNSSATTSGVWWTPSGSQEPRGCVLHPAGICRGQIHFK

SEQ ID NO: 878972 - protein, 135 aa, Homo sapiens
AAFRDIEEVSQGLLSLLGANRAEAQQRRLLGRHEQVVERLLETQDGAEKQLRGTWLNFTTKLVKLSGIMSVSQGWSKASIMAPVWPSPSTWTAPSSPGNSSATTSGVWWTPSGSQEPRGCVLHPAGICRGQIHFK

SEQ ID NO: 878973 - protein, 196 aa, Homo sapiens; identical to SEQ ID NO: 878968

SEQ ID NO: 878974 - protein, 169 aa, Homo sapiens
AAFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGSILFGEPF

SEQ ID NO: 878975 - protein, 107 aa, Homo sapiens
HVSHTHTHTHTHTHAHVSGMALRETVFDQRAKGSEVVSHRVILKKSIPRTGETSSKTSKPECSWCTQGTGQRPVWLGRWERARKRKITGDGINRKLGTRSCEACILI

SEQ ID NO: 878976 - protein, 102 aa, Homo sapiens
MCPPTKSILLLMHVLPWPAPCCLGLLSSWSRSLTHPAMCPSHPRLLSLTIFRHLSVYSSQFALTPLFPCCFVFWSWVTSSVAAFGHFGVLILVLTFGSWFST

SEQ ID NO: 878977 - protein, 128 aa, Homo sapiens
PQSLPGAWCAMATPSLRGRLARFGNPRKPVLKPNKPLILANRVGERRREKGEATCITEMSVMMACWKQNEFRDDACRKEIQGFLDCAARAQEARKMRSIQETLGESGSLLPNKLNKLLQRFPNKPYLS

SEQ ID NO: 878978 - protein, 83 aa, Homo sapiens
PQSLPGAWCAMATPSLRGRLARFGNPRKPVLKPNKPLILANRVGERRREKGGEQSESGRPRSGSRSMSRGGWVGGQEGGSSCD

SEQ ID NO: 878979 - protein, 128 aa, Homo sapiens; identical to SEQ ID NO: 878977

SEQ ID NO: 878980 - protein, 128 aa, Homo sapiens; identical to SEQ ID NO: 878977

SEQ ID NO: 878981 - protein, 107 aa, Homo sapiens
PQSLPGAWCAMATPSLRGRLARFGNPRKPVLKPNKPLILANRVGERRREKGEATCITEMSVMMACWKQNEFRDDACRKEIQGFLDCAARAQVTDGSWGAFSGKEWGR

SEQ ID NO: 878982 - protein, 277 aa, Homo sapiens
MFSAVSGETRGLRVSLSVFQSPGAVVQGLGLVMASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 878983 - protein, 277 aa, Homo sapiens; identical to SEQ ID NO: 878982

SEQ ID NO: 878984 - protein, 157 aa, Homo sapiens
MLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 878985 - protein, 259 aa, Homo sapiens
KFSAVSGETRGLRVSLSVFQSPGAVVQGLGLVMASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSDADKVNNEGCFIKVMTIIESEMGVVAGISFGVACFQLIGIFLAYCLSRAITNNQYEIV

SEQ ID NO: 878986 - protein, 180 aa, Homo sapiens
MANQQSSESTIEILSDVRLIKTGHNVGPRESTLLNMLKDLPLSPLGWSLQQVFDIGIIVRTLYMIALLQAIFRNRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 878987 - protein, 261 aa, Homo sapiens
KFSAVSGETRGLRVSLSVFQSPGAVVQGLGLVMASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKGCFIKVMTIIESEMGVVAGISFGVACFQLIGIFLAYCLSRAITNNQYEIV

SEQ ID NO: 878988 - protein, 232 aa, Homo sapiens
KFSAVSGETRGLRVSLSVFQSPGAVVQGLGLVMASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTGCFIKVMTIIESEMGVVAGISFGVACFQLIGIFLAYCLSRAITNNQYEIV

SEQ ID NO: 878989 - protein, 160 aa, Homo sapiens
MANQQSSESTIEILSDVRLIKTGHNVGPRESTLLNMLKDLPLSPLGWSLQQVFDIGIIVRTLYMIALLQAIFRNRSHAVDKIQNTLHCCGVTDYRDWTDTNYYSEKGFPKSCCKLEDCTPQRDADKVNNEGCFIKVMTIIESEMGVVAGISFGVACFQDI

SEQ ID NO: 878990 - protein, 277 aa, Homo sapiens; identical to SEQ ID NO: 878982

SEQ ID NO: 878991 - protein, 157 aa, Homo sapiens; identical to SEQ ID NO: 878984

SEQ ID NO: 878992 - protein, 277 aa, Homo sapiens; identical to SEQ ID NO: 878982

SEQ ID NO: 878993 - protein, 175 aa, Homo sapiens
IFWESNEILSDLEWIMIENKAGASEAQAVEHALNISPFSLGLVFQQVFDIGIIVRTLYMIALLQAIFRDRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 878994 - protein, 139 aa, Homo sapiens
MLKLYAMFLTLVFLVELVAAIVGFVFRHEIKNSFKNNYEKALKQYNSTGDYRSHAVDKIQNTLHCCGVTDYRDWTDTNYYSDADKVNNEGCFIKVMTIIESEMGVVAGISFGVACFQLIGIFLAYCLSRAITNNQYEIV

SEQ ID NO: 878995 - protein, 257 aa, Homo sapiens
MFSAVSGETRGLRVSLSVFQSPGAVVQGLGLVMASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQDI

SEQ ID NO: 878996 - protein, 870 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLDSPSVSVKPPDVQLTIAAEPSAEVGTSLVQQEATTRLSGSGNDIEPPAIQHGGPPLLSESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTIL

SEQ ID NO: 878997 - protein, 870 aa, Homo sapiens; identical to SEQ ID NO: 878996

SEQ ID NO: 878998 - protein, 273 aa, Homo sapiens
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 878999 - protein, 185 aa, Homo sapiens
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPESCIS

SEQ ID NO: 879000 - protein, 273 aa, Homo sapiens; identical to SEQ ID NO: 878998

SEQ ID NO: 879001 - protein, 273 aa, Homo sapiens; identical to SEQ ID NO: 878998

SEQ ID NO: 879002 - protein, 142 aa, Homo sapiens
MPPDFENSPFCLQSSTCKNLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 879003 - protein, 156 aa, Homo sapiens
MRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 879004 - protein, 142 aa, Homo sapiens; identical to SEQ ID NO: 879002

SEQ ID NO: 879005 - protein, 105 aa, Homo sapiens
KSCKSNRSIALEDWLQAEGLPPTCCATEGPGSCDLLLLPPSPSLSLPSAGGRHFPPSTCGPGSCRPLAGLLYASAIVAHDRHPEYLLRATPWFLTSLGRAALDLA

SEQ ID NO: 879006 - protein, 214 aa, Homo sapiens
HEVTIQVFLAGLLYASAIVAHDRHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 879007 - protein, 225 aa, Homo sapiens
HEVTIQVFLAGLLYASAIVAHDRHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEQKYWEALNSEQWDPEDVNLEGSKENVELLGSQVHQDSVRTAHLSDDD

SEQ ID NO: 879008 - protein, 125 aa, Homo sapiens
MPPDFENSPFCLQSSTCKNLDWVPLTTLSHCKSLRTMTAISRYMELTIEPVQQAGCSATRLPGDGQTSAGDASLQDPPSYPPVQVIRARVSSGSSSEVSSINSDLEWDPEDVNLQWCSSSPRLQH

SEQ ID NO: 879009 - protein, 252 aa, Homo sapiens
PQLGSRSYSPGPGRWEAAAAAALAHLGGARSRNQGRARGPGLASRSEMSAQRLISNRTSQQSASNSDYTWEYEYYEIGPVSFEGLKAHKYSIVIGFWVGLAVFVIFMFFVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 879010 - protein, 252 aa, Homo sapiens; identical to SEQ ID NO: 879009

SEQ ID NO: 879011 - protein, 464 aa, Homo sapiens
SGLPETSHKMAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKDTYLVYILNELAGNSFMIFCSTCNNTQRTALLLRNLGFTAIPLHGQMSQSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 879012 - protein, 264 aa, Homo sapiens
SGLPETSHKMAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKVKCLL

SEQ ID NO: 879013 - protein, 189 aa, Homo sapiens
MIFCSTCNNTQRTALLLRNLGFTAIPLHGQMSQSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 879014 - protein, 367 aa, Homo sapiens
SGLPETSHKMAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKDTYLVYILNELAGNSFMIFCSTCNNTQRTALLLRNLGFTAIPLHGQMSQSKRLGSLNKFKAKARSILLATDVASRGLDIPHVDVVVNFDIPTHSKDYIHRVGMSKLAA

SEQ ID NO: 879015 - protein, 105 aa, Homo sapiens [sequence omitted]

SEQ ID NO: 879016 - protein, 415 aa, Homo sapiens
SGLPETSHKMAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 879017 - protein, 464 aa, Homo sapiens; identical to SEQ ID NO: 879011

SEQ ID NO: 879018 - protein, 189 aa, Homo sapiens; identical to SEQ ID NO: 879013

SEQ ID NO: 879019 - protein, 105 aa, Homo sapiens [sequence omitted]

SEQ ID NO: 879020 - protein, 619 aa, Homo sapiens; identical to SEQ ID NO: 859409

SEQ ID NO: 879021 - protein, 472 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRLRLLKHTRRYEAVLIFFFFFF

SEQ ID NO: 879022 - protein, 451 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSIASSSFVNDNSLLASPNPPC

SEQ ID NO: 879023 - protein, 583 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK
